United States Patent 10,058,623 (COMPOSITIONS AND METHODS FOR MODULATING UTRN EXPRESSION) - sequence listing, part 13

SEQ ID NO: 476308 - DNA, 15 bp, Homo sapiens
actggcccagatgga

SEQ ID NO: 476309 - DNA, 15 bp, Homo sapiens
ctggcccagatggaa

SEQ ID NO: 476310 - DNA, 15 bp, Homo sapiens
tggcccagatggaaa

SEQ ID NO: 476311 - DNA, 15 bp, Homo sapiens
ggcccagatggaaag

SEQ ID NO: 476312 - DNA, 15 bp, Homo sapiens
gcccagatggaaagg

SEQ ID NO: 476313 - DNA, 15 bp, Homo sapiens
cccagatggaaagga

SEQ ID NO: 476314 - DNA, 15 bp, Homo sapiens
ccagatggaaaggac

SEQ ID NO: 476315 - DNA, 15 bp, Homo sapiens
cagatggaaaggact

SEQ ID NO: 476316 - DNA, 15 bp, Homo sapiens
agatggaaaggacta

SEQ ID NO: 476317 - DNA, 15 bp, Homo sapiens
gatggaaaggactaa

SEQ ID NO: 476318 - DNA, 15 bp, Homo sapiens
atggaaaggactaat

SEQ ID NO: 476319 - DNA, 15 bp, Homo sapiens
tggaaaggactaatg

SEQ ID NO: 476320 - DNA, 15 bp, Homo sapiens
ggaaaggactaatgg

SEQ ID NO: 476321 - DNA, 15 bp, Homo sapiens
gaaaggactaatggg

SEQ ID NO: 476322 - DNA, 15 bp, Homo sapiens
aaaggactaatgggt

SEQ ID NO: 476323 - DNA, 15 bp, Homo sapiens
aaggactaatgggtc

SEQ ID NO: 476324 - DNA, 15 bp, Homo sapiens
aggactaatgggtct

SEQ ID NO: 476325 - DNA, 15 bp, Homo sapiens
ggactaatgggtctt

SEQ ID NO: 476326 - DNA, 15 bp, Homo sapiens
gactaatgggtcttt

SEQ ID NO: 476327 - DNA, 15 bp, Homo sapiens
actaatgggtctttt

SEQ ID NO: 476328 - DNA, 15 bp, Homo sapiens
ctaatgggtcttttc

SEQ ID NO: 476329 - DNA, 15 bp, Homo sapiens
taatgggtcttttct

SEQ ID NO: 476330 - DNA, 15 bp, Homo sapiens
aatgggtcttttctc

SEQ ID NO: 476331 - DNA, 15 bp, Homo sapiens
atgggtcttttctca

SEQ ID NO: 476332 - DNA, 15 bp, Homo sapiens
tgggtcttttctcac

SEQ ID NO: 476333 - DNA, 15 bp, Homo sapiens
gggtcttttctcact

SEQ ID NO: 476334 - DNA, 15 bp, Homo sapiens
ggtcttttctcactg

SEQ ID NO: 476335 - DNA, 15 bp, Homo sapiens
gtcttttctcactga

SEQ ID NO: 476336 - DNA, 15 bp, Homo sapiens
cttttctcactgata

SEQ ID NO: 476337 - DNA, 15 bp, Homo sapiens
ttttctcactgatag

SEQ ID NO: 476338 - DNA, 15 bp, Homo sapiens
tttctcactgatagc

SEQ ID NO: 476339 - DNA, 15 bp, Homo sapiens
ttctcactgatagca

SEQ ID NO: 476340 - DNA, 15 bp, Homo sapiens
tctcactgatagcag

SEQ ID NO: 476341 - DNA, 15 bp, Homo sapiens
ctcactgatagcagc

SEQ ID NO: 476342 - DNA, 15 bp, Homo sapiens
tcactgatagcagct

SEQ ID NO: 476343 - DNA, 15 bp, Homo sapiens
cactgatagcagctc

SEQ ID NO: 476344 - DNA, 15 bp, Homo sapiens
actgatagcagctcc

SEQ ID NO: 476345 - DNA, 15 bp, Homo sapiens
ctgatagcagctcca

SEQ ID NO: 476346 - DNA, 15 bp, Homo sapiens
tgatagcagctccac

SEQ ID NO: 476347 - DNA, 15 bp, Homo sapiens
gatagcagctccacc

SEQ ID NO: 476348 - DNA, 15 bp, Homo sapiens
atagcagctccacca

SEQ ID NO: 476349 - DNA, 15 bp, Homo sapiens
tagcagctccaccac

SEQ ID NO: 476350 - DNA, 15 bp, Homo sapiens
agcagctccaccaca

SEQ ID NO: 476351 - DNA, 15 bp, Homo sapiens
gcagctccaccacag

SEQ ID NO: 476352 - DNA, 15 bp, Homo sapiens
cagctccaccacagg

SEQ ID NO: 476353 - DNA, 15 bp, Homo sapiens
agctccaccacagga

SEQ ID NO: 476354 - DNA, 15 bp, Homo sapiens
gctccaccacaggaa

SEQ ID NO: 476355 - DNA, 15 bp, Homo sapiens
ctccaccacaggaag

SEQ ID NO: 476356 - DNA, 15 bp, Homo sapiens
tccaccacaggaagt

SEQ ID NO: 476357 - DNA, 15 bp, Homo sapiens
ccaccacaggaagtg

SEQ ID NO: 476358 - DNA, 15 bp, Homo sapiens
caccacaggaagtgt

SEQ ID NO: 476359 - DNA, 15 bp, Homo sapiens
accacaggaagtgtg

SEQ ID NO: 476360 - DNA, 15 bp, Homo sapiens
ccacaggaagtgtgt

SEQ ID NO: 476361 - DNA, 15 bp, Homo sapiens
cacaggaagtgtgta

SEQ ID NO: 476362 - DNA, 15 bp, Homo sapiens
acaggaagtgtgtaa

SEQ ID NO: 476363 - DNA, 15 bp, Homo sapiens
caggaagtgtgtaag

SEQ ID NO: 476364 - DNA, 15 bp, Homo sapiens
aggaagtgtgtaagt

SEQ ID NO: 476365 - DNA, 15 bp, Homo sapiens
ggaagtgtgtaagta

SEQ ID NO: 476366 - DNA, 15 bp, Homo sapiens
gaagtgtgtaagtaa

SEQ ID NO: 476367 - DNA, 15 bp, Homo sapiens
aagtgtgtaagtaaa

SEQ ID NO: 476368 - DNA, 15 bp, Homo sapiens
agtgtgtaagtaaat

SEQ ID NO: 476369 - DNA, 15 bp, Homo sapiens
gtgtgtaagtaaatc

SEQ ID NO: 476370 - DNA, 15 bp, Homo sapiens
tgtgtaagtaaatca

SEQ ID NO: 476371 - DNA, 15 bp, Homo sapiens
gtgtaagtaaatcat

SEQ ID NO: 476372 - DNA, 15 bp, Homo sapiens
tgtaagtaaatcatg

SEQ ID NO: 476373 - DNA, 15 bp, Homo sapiens
gtaagtaaatcatga

SEQ ID NO: 476374 - DNA, 15 bp, Homo sapiens
taagtaaatcatgaa

SEQ ID NO: 476375 - DNA, 15 bp, Homo sapiens
aagtaaatcatgaaa

SEQ ID NO: 476376 - DNA, 15 bp, Homo sapiens
agtaaatcatgaaat

SEQ ID NO: 476377 - DNA, 15 bp, Homo sapiens
gtaaatcatgaaatt

SEQ ID NO: 476378 - DNA, 15 bp, Homo sapiens
taaatcatgaaatta

SEQ ID NO: 476379 - DNA, 15 bp, Homo sapiens
aaatcatgaaattag

SEQ ID NO: 476380 - DNA, 15 bp, Homo sapiens
aatcatgaaattagt

SEQ ID NO: 476381 - DNA, 15 bp, Homo sapiens
atcatgaaattagtg

SEQ ID NO: 476382 - DNA, 15 bp, Homo sapiens
tcatgaaattagtgc

SEQ ID NO: 476383 - DNA, 15 bp, Homo sapiens
catgaaattagtgct

SEQ ID NO: 476384 - DNA, 15 bp, Homo sapiens
atgaaattagtgctg

SEQ ID NO: 476385 - DNA, 15 bp, Homo sapiens
tgaaattagtgctgc

SEQ ID NO: 476386 - DNA, 15 bp, Homo sapiens
gaaattagtgctgcc

SEQ ID NO: 476387 - DNA, 15 bp, Homo sapiens
aaattagtgctgcct

SEQ ID NO: 476388 - DNA, 15 bp, Homo sapiens
aattagtgctgcctg

SEQ ID NO: 476389 - DNA, 15 bp, Homo sapiens
attagtgctgcctgg

SEQ ID NO: 476390 - DNA, 15 bp, Homo sapiens
ttagtgctgcctggg

SEQ ID NO: 476391 - DNA, 15 bp, Homo sapiens
tagtgctgcctggga

SEQ ID NO: 476392 - DNA, 15 bp, Homo sapiens
agtgctgcctgggaa

SEQ ID NO: 476393 - DNA, 15 bp, Homo sapiens
gtgctgcctgggaag

SEQ ID NO: 476394 - DNA, 15 bp, Homo sapiens
tgctgcctgggaagg

SEQ ID NO: 476395 - DNA, 15 bp, Homo sapiens
gctgcctgggaaggc

SEQ ID NO: 476396 - DNA, 15 bp, Homo sapiens
ctgcctgggaaggct

SEQ ID NO: 476397 - DNA, 15 bp, Homo sapiens
tgcctgggaaggcta

SEQ ID NO: 476398 - DNA, 15 bp, Homo sapiens
gcctgggaaggctag

SEQ ID NO: 476399 - DNA, 15 bp, Homo sapiens
cctgggaaggctagt

SEQ ID NO: 476400 - DNA, 15 bp, Homo sapiens
ctgggaaggctagtt

SEQ ID NO: 476401 - DNA, 15 bp, Homo sapiens
tgggaaggctagttc

SEQ ID NO: 476402 - DNA, 15 bp, Homo sapiens
gggaaggctagttct

SEQ ID NO: 476403 - DNA, 15 bp, Homo sapiens
ggaaggctagttctt

SEQ ID NO: 476404 - DNA, 15 bp, Homo sapiens
gaaggctagttcttg

SEQ ID NO: 476405 - DNA, 15 bp, Homo sapiens
aaggctagttcttgt

SEQ ID NO: 476406 - DNA, 15 bp, Homo sapiens
aggctagttcttgta

SEQ ID NO: 476407 - DNA, 15 bp, Homo sapiens
ggctagttcttgtat

SEQ ID NO: 476408 - DNA, 15 bp, Homo sapiens
gctagttcttgtatt

SEQ ID NO: 476409 - DNA, 15 bp, Homo sapiens
ctagttcttgtatta

SEQ ID NO: 476410 - DNA, 15 bp, Homo sapiens
tagttcttgtattat

SEQ ID NO: 476411 - DNA, 15 bp, Homo sapiens
agttcttgtattatg

SEQ ID NO: 476412 - DNA, 15 bp, Homo sapiens
gttcttgtattatgg

SEQ ID NO: 476413 - DNA, 15 bp, Homo sapiens
ttcttgtattatggc

SEQ ID NO: 476414 - DNA, 15 bp, Homo sapiens
tcttgtattatggct

SEQ ID NO: 476415 - DNA, 15 bp, Homo sapiens
cttgtattatggctg

SEQ ID NO: 476416 - DNA, 15 bp, Homo sapiens
ttgtattatggctgt

SEQ ID NO: 476417 - DNA, 15 bp, Homo sapiens
tgtattatggctgtc

SEQ ID NO: 476418 - DNA, 15 bp, Homo sapiens
gtattatggctgtca

SEQ ID NO: 476419 - DNA, 15 bp, Homo sapiens
tattatggctgtcag

SEQ ID NO: 476420 - DNA, 15 bp, Homo sapiens
attatggctgtcaga

SEQ ID NO: 476421 - DNA, 15 bp, Homo sapiens
ttatggctgtcagaa

SEQ ID NO: 476422 - DNA, 15 bp, Homo sapiens
tatggctgtcagaaa

SEQ ID NO: 476423 - DNA, 15 bp, Homo sapiens
atggctgtcagaaac

SEQ ID NO: 476424 - DNA, 15 bp, Homo sapiens
tggctgtcagaaaca

SEQ ID NO: 476425 - DNA, 15 bp, Homo sapiens
ggctgtcagaaacaa

SEQ ID NO: 476426 - DNA, 15 bp, Homo sapiens
gctgtcagaaacaat

SEQ ID NO: 476427 - DNA, 15 bp, Homo sapiens
ctgtcagaaacaatc

SEQ ID NO: 476428 - DNA, 15 bp, Homo sapiens
tgtcagaaacaatct

SEQ ID NO: 476429 - DNA, 15 bp, Homo sapiens
gtcagaaacaatctt

SEQ ID NO: 476430 - DNA, 15 bp, Homo sapiens
tcagaaacaatcttc

SEQ ID NO: 476431 - DNA, 15 bp, Homo sapiens
cagaaacaatcttca

SEQ ID NO: 476432 - DNA, 15 bp, Homo sapiens
agaaacaatcttcac

SEQ ID NO: 476433 - DNA, 15 bp, Homo sapiens
gaaacaatcttcact

SEQ ID NO: 476434 - DNA, 15 bp, Homo sapiens
aaacaatcttcactg

SEQ ID NO: 476435 - DNA, 15 bp, Homo sapiens
aacaatcttcactga

SEQ ID NO: 476436 - DNA, 15 bp, Homo sapiens
acaatcttcactgat

SEQ ID NO: 476437 - DNA, 15 bp, Homo sapiens
caatcttcactgatg

SEQ ID NO: 476438 - DNA, 15 bp, Homo sapiens
aatcttcactgatgt

SEQ ID NO: 476439 - DNA, 15 bp, Homo sapiens
atcttcactgatgtg

SEQ ID NO: 476440 - DNA, 15 bp, Homo sapiens
tcttcactgatgtgg

SEQ ID NO: 476441 - DNA, 15 bp, Homo sapiens
cttcactgatgtggc

SEQ ID NO: 476442 - DNA, 15 bp, Homo sapiens
ttcactgatgtggct

SEQ ID NO: 476443 - DNA, 15 bp, Homo sapiens
tcactgatgtggctc

SEQ ID NO: 476444 - DNA, 15 bp, Homo sapiens
cactgatgtggctct

SEQ ID NO: 476445 - DNA, 15 bp, Homo sapiens
actgatgtggctctg

SEQ ID NO: 476446 - DNA, 15 bp, Homo sapiens
ctgatgtggctctga

SEQ ID NO: 476447 - DNA, 15 bp, Homo sapiens
tgatgtggctctgaa

SEQ ID NO: 476448 - DNA, 15 bp, Homo sapiens
gatgtggctctgaat

SEQ ID NO: 476449 - DNA, 15 bp, Homo sapiens
atgtggctctgaatc

SEQ ID NO: 476450 - DNA, 15 bp, Homo sapiens
tgtggctctgaatct

SEQ ID NO: 476451 - DNA, 15 bp, Homo sapiens
gtggctctgaatctt

SEQ ID NO: 476452 - DNA, 15 bp, Homo sapiens
tggctctgaatcttg

SEQ ID NO: 476453 - DNA, 15 bp, Homo sapiens
ggctctgaatcttga

SEQ ID NO: 476454 - DNA, 15 bp, Homo sapiens
gctctgaatcttgat

SEQ ID NO: 476455 - DNA, 15 bp, Homo sapiens
ctctgaatcttgatc

SEQ ID NO: 476456 - DNA, 15 bp, Homo sapiens
tctgaatcttgatcc

SEQ ID NO: 476457 - DNA, 15 bp, Homo sapiens
ctgaatcttgatccc

SEQ ID NO: 476458 - DNA, 15 bp, Homo sapiens
tgaatcttgatccca

SEQ ID NO: 476459 - DNA, 15 bp, Homo sapiens
gaatcttgatcccaa

SEQ ID NO: 476460 - DNA, 15 bp, Homo sapiens
aatcttgatcccaat

SEQ ID NO: 476461 - DNA, 15 bp, Homo sapiens
atcttgatcccaatc

SEQ ID NO: 476462 - DNA, 15 bp, Homo sapiens
tcttgatcccaatca

SEQ ID NO: 476463 - DNA, 15 bp, Homo sapiens
cttgatcccaatcaa

SEQ ID NO: 476464 - DNA, 15 bp, Homo sapiens
ttgatcccaatcaaa

SEQ ID NO: 476465 - DNA, 15 bp, Homo sapiens
tgatcccaatcaaaa

SEQ ID NO: 476466 - DNA, 15 bp, Homo sapiens
gatcccaatcaaaat

SEQ ID NO: 476467 - DNA, 15 bp, Homo sapiens
atcccaatcaaaatt

SEQ ID NO: 476468 - DNA, 15 bp, Homo sapiens
tcccaatcaaaatta

SEQ ID NO: 476469 - DNA, 15 bp, Homo sapiens
cccaatcaaaattat

SEQ ID NO: 476470 - DNA, 15 bp, Homo sapiens
ccaatcaaaattatt

SEQ ID NO: 476471 - DNA, 15 bp, Homo sapiens
caatcaaaattatta

SEQ ID NO: 476472 - DNA, 15 bp, Homo sapiens
aatcaaaattattaa

SEQ ID NO: 476473 - DNA, 15 bp, Homo sapiens
atcaaaattattaag

SEQ ID NO: 476474 - DNA, 15 bp, Homo sapiens
tcaaaattattaagt

SEQ ID NO: 476475 - DNA, 15 bp, Homo sapiens
caaaattattaagtg

SEQ ID NO: 476476 - DNA, 15 bp, Homo sapiens
aaaattattaagtgt

SEQ ID NO: 476477 - DNA, 15 bp, Homo sapiens
aaattattaagtgtg

SEQ ID NO: 476478 - DNA, 15 bp, Homo sapiens
aattattaagtgtgg

SEQ ID NO: 476479 - DNA, 15 bp, Homo sapiens
attattaagtgtggt

SEQ ID NO: 476480 - DNA, 15 bp, Homo sapiens
ttattaagtgtggtt

SEQ ID NO: 476481 - DNA, 15 bp, Homo sapiens
tattaagtgtggttc

SEQ ID NO: 476482 - DNA, 15 bp, Homo sapiens
attaagtgtggttcc

SEQ ID NO: 476483 - DNA, 15 bp, Homo sapiens
ttaagtgtggttcca

SEQ ID NO: 476484 - DNA, 15 bp, Homo sapiens
taagtgtggttccaa

SEQ ID NO: 476485 - DNA, 15 bp, Homo sapiens
aagtgtggttccaaa

SEQ ID NO: 476486 - DNA, 15 bp, Homo sapiens
agtgtggttccaaaa

SEQ ID NO: 476487 - DNA, 15 bp, Homo sapiens
gtgtggttccaaaaa

SEQ ID NO: 476488 - DNA, 15 bp, Homo sapiens
tgtggttccaaaaat

SEQ ID NO: 476489 - DNA, 15 bp, Homo sapiens
tggttccaaaaattt

SEQ ID NO: 476490 - DNA, 15 bp, Homo sapiens
ggttccaaaaatttc

SEQ ID NO: 476491 - DNA, 15 bp, Homo sapiens
gttccaaaaatttct

SEQ ID NO: 476492 - DNA, 15 bp, Homo sapiens
ttccaaaaatttcta

SEQ ID NO: 476493 - DNA, 15 bp, Homo sapiens
tccaaaaatttctac

SEQ ID NO: 476494 - DNA, 15 bp, Homo sapiens
ccaaaaatttctacg

SEQ ID NO: 476495 - DNA, 15 bp, Homo sapiens
caaaaatttctacgt

SEQ ID NO: 476496 - DNA, 15 bp, Homo sapiens
aaaaatttctacgta

SEQ ID NO: 476497 - DNA, 15 bp, Homo sapiens
aaaatttctacgtag

SEQ ID NO: 476498 - DNA, 15 bp, Homo sapiens
aaatttctacgtaga

SEQ ID NO: 476499 - DNA, 15 bp, Homo sapiens
aatttctacgtagat

SEQ ID NO: 476500 - DNA, 15 bp, Homo sapiens
atttctacgtagatt

SEQ ID NO: 476501 - DNA, 15 bp, Homo sapiens
tttctacgtagattt

SEQ ID NO: 476502 - DNA, 15 bp, Homo sapiens
ttctacgtagatttt

SEQ ID NO: 476503 - DNA, 15 bp, Homo sapiens
tctacgtagatttta

SEQ ID NO: 476504 - DNA, 15 bp, Homo sapiens
ctacgtagattttat

SEQ ID NO: 476505 - DNA, 15 bp, Homo sapiens
tacgtagattttatg

SEQ ID NO: 476506 - DNA, 15 bp, Homo sapiens
acgtagattttatgc

SEQ ID NO: 476507 - DNA, 15 bp, Homo sapiens
cgtagattttatgct

SEQ ID NO: 476508 - DNA, 15 bp, Homo sapiens
gtagattttatgctt

SEQ ID NO: 476509 - DNA, 15 bp, Homo sapiens
tagattttatgcttt

SEQ ID NO: 476510 - DNA, 15 bp, Homo sapiens
agattttatgctttc

SEQ ID NO: 476511 - DNA, 15 bp, Homo sapiens
gattttatgctttca

SEQ ID NO: 476512 - DNA, 15 bp, Homo sapiens
attttatgctttcaa

SEQ ID NO: 476513 - DNA, 15 bp, Homo sapiens
ttttatgctttcaaa

SEQ ID NO: 476514 - DNA, 15 bp, Homo sapiens
tttatgctttcaaac

SEQ ID NO: 476515 - DNA, 15 bp, Homo sapiens
ttatgctttcaaacc

SEQ ID NO: 476516 - DNA, 15 bp, Homo sapiens
tatgctttcaaacca

SEQ ID NO: 476517 - DNA, 15 bp, Homo sapiens
atgctttcaaaccat

SEQ ID NO: 476518 - DNA, 15 bp, Homo sapiens
tgctttcaaaccatg

SEQ ID NO: 476519 - DNA, 15 bp, Homo sapiens
gctttcaaaccatga

SEQ ID NO: 476520 - DNA, 15 bp, Homo sapiens
ctttcaaaccatgat

SEQ ID NO: 476521 - DNA, 15 bp, Homo sapiens
tttcaaaccatgata

SEQ ID NO: 476522 - DNA, 15 bp, Homo sapiens
ttcaaaccatgatag

SEQ ID NO: 476523 - DNA, 15 bp, Homo sapiens
tcaaaccatgatagt

SEQ ID NO: 476524 - DNA, 15 bp, Homo sapiens
caaaccatgatagta

SEQ ID NO: 476525 - DNA, 15 bp, Homo sapiens
aaaccatgatagtat

SEQ ID NO: 476526 - DNA, 15 bp, Homo sapiens
aaccatgatagtata

SEQ ID NO: 476527 - DNA, 15 bp, Homo sapiens
accatgatagtataa

SEQ ID NO: 476528 - DNA, 15 bp, Homo sapiens
ccatgatagtataaa

SEQ ID NO: 476529 - DNA, 15 bp, Homo sapiens
catgatagtataaac

SEQ ID NO: 476530 - DNA, 15 bp, Homo sapiens
atgatagtataaact

SEQ ID NO: 476531 - DNA, 15 bp, Homo sapiens
tgatagtataaactc

SEQ ID NO: 476532 - DNA, 15 bp, Homo sapiens
gatagtataaactca

SEQ ID NO: 476533 - DNA, 15 bp, Homo sapiens
atagtataaactcaa

SEQ ID NO: 476534 - DNA, 15 bp, Homo sapiens
tagtataaactcaat

SEQ ID NO: 476535 - DNA, 15 bp, Homo sapiens
agtataaactcaata

SEQ ID NO: 476536 - DNA, 15 bp, Homo sapiens
gtataaactcaatat

SEQ ID NO: 476537 - DNA, 15 bp, Homo sapiens
tataaactcaatatg

SEQ ID NO: 476538 - DNA, 15 bp, Homo sapiens
ataaactcaatatgt

SEQ ID NO: 476539 - DNA, 15 bp, Homo sapiens
taaactcaatatgtt

SEQ ID NO: 476540 - DNA, 15 bp, Homo sapiens
aaactcaatatgttt

SEQ ID NO: 476541 - DNA, 15 bp, Homo sapiens
aactcaatatgttta

SEQ ID NO: 476542 - DNA, 15 bp, Homo sapiens
actcaatatgtttat

SEQ ID NO: 476543 - DNA, 15 bp, Homo sapiens
ctcaatatgtttatt

SEQ ID NO: 476544 - DNA, 15 bp, Homo sapiens
tcaatatgtttattt

SEQ ID NO: 476545 - DNA, 15 bp, Homo sapiens
caatatgtttattta

SEQ ID NO: 476546 - DNA, 15 bp, Homo sapiens
aatatgtttatttac

SEQ ID NO: 476547 - DNA, 15 bp, Homo sapiens
atatgtttatttact

SEQ ID NO: 476548 - DNA, 15 bp, Homo sapiens
tatgtttatttactt

SEQ ID NO: 476549 - DNA, 15 bp, Homo sapiens
atgtttatttacttt

SEQ ID NO: 476550 - DNA, 15 bp, Homo sapiens
gtttatttactttgt

SEQ ID NO: 476551 - DNA, 15 bp, Homo sapiens
tttatttactttgtt

SEQ ID NO: 476552 - DNA, 15 bp, Homo sapiens
ttatttactttgttt

SEQ ID NO: 476553 - DNA, 15 bp, Homo sapiens
tatttactttgtttc

SEQ ID NO: 476554 - DNA, 15 bp, Homo sapiens
atttactttgtttca

SEQ ID NO: 476555 - DNA, 15 bp, Homo sapiens
tttactttgtttcat

SEQ ID NO: 476556 - DNA, 15 bp, Homo sapiens
ttactttgtttcata

SEQ ID NO: 476557 - DNA, 15 bp, Homo sapiens
ctttgtttcatataa

SEQ ID NO: 476558 - DNA, 15 bp, Homo sapiens
tttgtttcatataag

SEQ ID NO: 476559 - DNA, 15 bp, Homo sapiens
ttgtttcatataagt

SEQ ID NO: 476560 - DNA, 15 bp, Homo sapiens
tgtttcatataagtt

SEQ ID NO: 476561 - DNA, 15 bp, Homo sapiens
gtttcatataagtta

SEQ ID NO: 476562 - DNA, 15 bp, Homo sapiens
tttcatataagttaa

SEQ ID NO: 476563 - DNA, 15 bp, Homo sapiens
ttcatataagttaat

SEQ ID NO: 476564 - DNA, 15 bp, Homo sapiens
tcatataagttaatg

SEQ ID NO: 476565 - DNA, 15 bp, Homo sapiens
catataagttaatga

SEQ ID NO: 476566 - DNA, 15 bp, Homo sapiens
atataagttaatgaa

SEQ ID NO: 476567 - DNA, 15 bp, Homo sapiens
tataagttaatgaaa

SEQ ID NO: 476568 - DNA, 15 bp, Homo sapiens
ataagttaatgaaaa

SEQ ID NO: 476569 - DNA, 15 bp, Homo sapiens
taagttaatgaaaaa

SEQ ID NO: 476570 - DNA, 15 bp, Homo sapiens
aagttaatgaaaaaa

SEQ ID NO: 476571 - DNA, 15 bp, Homo sapiens
agttaatgaaaaaaa

SEQ ID NO: 476572 - DNA, 15 bp, Homo sapiens
gttaatgaaaaaaat

SEQ ID NO: 476573 - DNA, 15 bp, Homo sapiens
ttaatgaaaaaaatc

SEQ ID NO: 476574 - DNA, 15 bp, Homo sapiens
taatgaaaaaaatct

SEQ ID NO: 476575 - DNA, 15 bp, Homo sapiens
aatgaaaaaaatctt

SEQ ID NO: 476576 - DNA, 15 bp, Homo sapiens
atgaaaaaaatctta

SEQ ID NO: 476577 - DNA, 15 bp, Homo sapiens
tgaaaaaaatcttac

SEQ ID NO: 476578 - DNA, 15 bp, Homo sapiens
gaaaaaaatcttaca

SEQ ID NO: 476579 - DNA, 15 bp, Homo sapiens
aaaaaaatcttacat

SEQ ID NO: 476580 - DNA, 15 bp, Homo sapiens
aaaaaatcttacatt

SEQ ID NO: 476581 - DNA, 15 bp, Homo sapiens
aaaaatcttacattt

SEQ ID NO: 476582 - DNA, 15 bp, Homo sapiens
aaaatcttacatttg

SEQ ID NO: 476583 - DNA, 15 bp, Homo sapiens
aaatcttacatttgt

SEQ ID NO: 476584 - DNA, 15 bp, Homo sapiens
aatcttacatttgtc

SEQ ID NO: 476585 - DNA, 15 bp, Homo sapiens
atcttacatttgtca

SEQ ID NO: 476586 - DNA, 15 bp, Homo sapiens
tcttacatttgtcaa

SEQ ID NO: 476587 - DNA, 15 bp, Homo sapiens
cttacatttgtcaac

SEQ ID NO: 476588 - DNA, 15 bp, Homo sapiens
ttacatttgtcaact

SEQ ID NO: 476589 - DNA, 15 bp, Homo sapiens
tacatttgtcaactt

SEQ ID NO: 476590 - DNA, 15 bp, Homo sapiens
acatttgtcaactta

SEQ ID NO: 476591 - DNA, 15 bp, Homo sapiens
catttgtcaacttat

SEQ ID NO: 476592 - DNA, 15 bp, Homo sapiens
atttgtcaacttata

SEQ ID NO: 476593 - DNA, 15 bp, Homo sapiens
tttgtcaacttatat

SEQ ID NO: 476594 - DNA, 15 bp, Homo sapiens
ttgtcaacttatata

SEQ ID NO: 476595 - DNA, 15 bp, Homo sapiens
tgtcaacttatatac

SEQ ID NO: 476596 - DNA, 15 bp, Homo sapiens
gtcaacttatatacc

SEQ ID NO: 476597 - DNA, 15 bp, Homo sapiens
tcaacttatataccc

SEQ ID NO: 476598 - DNA, 15 bp, Homo sapiens
caacttatatacccc

SEQ ID NO: 476599 - DNA, 15 bp, Homo sapiens
aacttatatacccca

SEQ ID NO: 476600 - DNA, 15 bp, Homo sapiens
acttatataccccac

SEQ ID NO: 476601 - DNA, 15 bp, Homo sapiens
cttatataccccacg

SEQ ID NO: 476602 - DNA, 15 bp, Homo sapiens
ttatataccccacga

SEQ ID NO: 476603 - DNA, 15 bp, Homo sapiens
tatataccccacgaa

SEQ ID NO: 476604 - DNA, 15 bp, Homo sapiens
atataccccacgaaa

SEQ ID NO: 476605 - DNA, 15 bp, Homo sapiens
tataccccacgaaaa

SEQ ID NO: 476606 - DNA, 15 bp, Homo sapiens
ataccccacgaaaat

SEQ ID NO: 476607 - DNA, 15 bp, Homo sapiens
taccccacgaaaatc

SEQ ID NO: 476608 - DNA, 15 bp, Homo sapiens
accccacgaaaatca

SEQ ID NO: 476609 - DNA, 15 bp, Homo sapiens
ccccacgaaaatcag

SEQ ID NO: 476610 - DNA, 15 bp, Homo sapiens
cccacgaaaatcaga

SEQ ID NO: 476611 - DNA, 15 bp, Homo sapiens
ccacgaaaatcagat

SEQ ID NO: 476612 - DNA, 15 bp, Homo sapiens
cacgaaaatcagatt

SEQ ID NO: 476613 - DNA, 15 bp, Homo sapiens
acgaaaatcagattg

SEQ ID NO: 476614 - DNA, 15 bp, Homo sapiens
cgaaaatcagattgt

SEQ ID NO: 476615 - DNA, 15 bp, Homo sapiens
gaaaatcagattgtt

SEQ ID NO: 476616 - DNA, 15 bp, Homo sapiens
aaaatcagattgttt

SEQ ID NO: 476617 - DNA, 15 bp, Homo sapiens
aaatcagattgtttt

SEQ ID NO: 476618 - DNA, 15 bp, Homo sapiens
aatcagattgtttta

SEQ ID NO: 476619 - DNA, 15 bp, Homo sapiens
atcagattgttttat

SEQ ID NO: 476620 - DNA, 15 bp, Homo sapiens
tcagattgttttatt

SEQ ID NO: 476621 - DNA, 15 bp, Homo sapiens
cagattgttttattt

SEQ ID NO: 476622 - DNA, 15 bp, Homo sapiens
agattgttttattta

SEQ ID NO: 476623 - DNA, 15 bp, Homo sapiens
gattgttttatttag

SEQ ID NO: 476624 - DNA, 15 bp, Homo sapiens
attgttttatttagg

SEQ ID NO: 476625 - DNA, 15 bp, Homo sapiens
ttgttttatttagga

SEQ ID NO: 476626 - DNA, 15 bp, Homo sapiens
tgttttatttaggat

SEQ ID NO: 476627 - DNA, 15 bp, Homo sapiens
gttttatttaggata

SEQ ID NO: 476628 - DNA, 15 bp, Homo sapiens
ttttatttaggataa

SEQ ID NO: 476629 - DNA, 15 bp, Homo sapiens
tttatttaggataac

SEQ ID NO: 476630 - DNA, 15 bp, Homo sapiens
ttatttaggataaca

SEQ ID NO: 476631 - DNA, 15 bp, Homo sapiens
tatttaggataacag

SEQ ID NO: 476632 - DNA, 15 bp, Homo sapiens
atttaggataacagg

SEQ ID NO: 476633 - DNA, 15 bp, Homo sapiens
tttaggataacaggt

SEQ ID NO: 476634 - DNA, 15 bp, Homo sapiens
ttaggataacaggtg

SEQ ID NO: 476635 - DNA, 15 bp, Homo sapiens
taggataacaggtgt

SEQ ID NO: 476636 - DNA, 15 bp, Homo sapiens
aggataacaggtgta

SEQ ID NO: 476637 - DNA, 15 bp, Homo sapiens
ggataacaggtgtat

SEQ ID NO: 476638 - DNA, 15 bp, Homo sapiens
gataacaggtgtata

SEQ ID NO: 476639 - DNA, 15 bp, Homo sapiens
ataacaggtgtatat

SEQ ID NO: 476640 - DNA, 15 bp, Homo sapiens
taacaggtgtatata

SEQ ID NO: 476641 - DNA, 15 bp, Homo sapiens
aacaggtgtatatat

SEQ ID NO: 476642 - DNA, 15 bp, Homo sapiens
acaggtgtatatatt

SEQ ID NO: 476643 - DNA, 15 bp, Homo sapiens
caggtgtatatattc

SEQ ID NO: 476644 - DNA, 15 bp, Homo sapiens
aggtgtatatattca

SEQ ID NO: 476645 - DNA, 15 bp, Homo sapiens
ggtgtatatattcat

SEQ ID NO: 476646 - DNA, 15 bp, Homo sapiens
gtgtatatattcatt

SEQ ID NO: 476647 - DNA, 15 bp, Homo sapiens
tgtatatattcattc

SEQ ID NO: 476648 - DNA, 15 bp, Homo sapiens
gtatatattcattcc

SEQ ID NO: 476649 - DNA, 15 bp, Homo sapiens
tatatattcattcca

SEQ ID NO: 476650 - DNA, 15 bp, Homo sapiens
atatattcattccat

SEQ ID NO: 476651 - DNA, 15 bp, Homo sapiens
tatattcattccatt

SEQ ID NO: 476652 - DNA, 15 bp, Homo sapiens
atattcattccattt

SEQ ID NO: 476653 - DNA, 15 bp, Homo sapiens
tattcattccatttg

SEQ ID NO: 476654 - DNA, 15 bp, Homo sapiens
attcattccatttgt

SEQ ID NO: 476655 - DNA, 15 bp, Homo sapiens
ttcattccatttgtc

SEQ ID NO: 476656 - DNA, 15 bp, Homo sapiens
tcattccatttgtct

SEQ ID NO: 476657 - DNA, 15 bp, Homo sapiens
cattccatttgtctt

SEQ ID NO: 476658 - DNA, 15 bp, Homo sapiens
attccatttgtctta

SEQ ID NO: 476659 - DNA, 15 bp, Homo sapiens
ttccatttgtcttat

SEQ ID NO: 476660 - DNA, 15 bp, Homo sapiens
ccatttgtcttatat

SEQ ID NO: 476661 - DNA, 15 bp, Homo sapiens
catttgtcttatatt

SEQ ID NO: 476662 - DNA, 15 bp, Homo sapiens
atttgtcttatattt

SEQ ID NO: 476663 - DNA, 15 bp, Homo sapiens
tttgtcttatatttc

SEQ ID NO: 476664 - DNA, 15 bp, Homo sapiens
ttgtcttatatttct

SEQ ID NO: 476665 - DNA, 15 bp, Homo sapiens
tgtcttatatttctt

SEQ ID NO: 476666 - DNA, 15 bp, Homo sapiens
gtcttatatttctta

SEQ ID NO: 476667 - DNA, 15 bp, Homo sapiens
tcttatatttcttat

SEQ ID NO: 476668 - DNA, 15 bp, Homo sapiens
cttatatttcttatt

SEQ ID NO: 476669 - DNA, 15 bp, Homo sapiens
ttatatttcttatta

SEQ ID NO: 476670 - DNA, 15 bp, Homo sapiens
tatatttcttattaa

SEQ ID NO: 476671 - DNA, 15 bp, Homo sapiens
atatttcttattaat

SEQ ID NO: 476672 - DNA, 15 bp, Homo sapiens
tatttcttattaatt

SEQ ID NO: 476673 - DNA, 15 bp, Homo sapiens
atttcttattaattt

SEQ ID NO: 476674 - DNA, 15 bp, Homo sapiens
tttcttattaattta

SEQ ID NO: 476675 - DNA, 15 bp, Homo sapiens
ttcttattaatttaa

SEQ ID NO: 476676 - DNA, 15 bp, Homo sapiens
tcttattaatttaac

SEQ ID NO: 476677 - DNA, 15 bp, Homo sapiens
cttattaatttaaca

SEQ ID NO: 476678 - DNA, 15 bp, Homo sapiens
ttattaatttaacaa

SEQ ID NO: 476679 - DNA, 15 bp, Homo sapiens
tattaatttaacaaa

SEQ ID NO: 476680 - DNA, 15 bp, Homo sapiens
attaatttaacaaag

SEQ ID NO: 476681 - DNA, 15 bp, Homo sapiens
ttaatttaacaaagg

SEQ ID NO: 476682 - DNA, 15 bp, Homo sapiens
taatttaacaaaggt

SEQ ID NO: 476683 - DNA, 15 bp, Homo sapiens
aatttaacaaaggta

SEQ ID NO: 476684 - DNA, 15 bp, Homo sapiens
atttaacaaaggtaa

SEQ ID NO: 476685 - DNA, 15 bp, Homo sapiens
tttaacaaaggtaat

SEQ ID NO: 476686 - DNA, 15 bp, Homo sapiens
ttaacaaaggtaatt

SEQ ID NO: 476687 - DNA, 15 bp, Homo sapiens
taacaaaggtaattt

SEQ ID NO: 476688 - DNA, 15 bp, Homo sapiens
aacaaaggtaatttg

SEQ ID NO: 476689 - DNA, 15 bp, Homo sapiens
acaaaggtaatttga

SEQ ID NO: 476690 - DNA, 15 bp, Homo sapiens
caaaggtaatttgac

SEQ ID NO: 476691 - DNA, 15 bp, Homo sapiens
aaaggtaatttgaca

SEQ ID NO: 476692 - DNA, 15 bp, Homo sapiens
aaggtaatttgacag

SEQ ID NO: 476693 - DNA, 15 bp, Homo sapiens
aggtaatttgacaga

SEQ ID NO: 476694 - DNA, 15 bp, Homo sapiens
ggtaatttgacagaa

SEQ ID NO: 476695 - DNA, 15 bp, Homo sapiens
gtaatttgacagaat

SEQ ID NO: 476696 - DNA, 15 bp, Homo sapiens
taatttgacagaata

SEQ ID NO: 476697 - DNA, 15 bp, Homo sapiens
aatttgacagaatat

SEQ ID NO: 476698 - DNA, 15 bp, Homo sapiens
atttgacagaatatg

SEQ ID NO: 476699 - DNA, 15 bp, Homo sapiens
tttgacagaatatgt

SEQ ID NO: 476700 - DNA, 15 bp, Homo sapiens
ttgacagaatatgtg

SEQ ID NO: 476701 - DNA, 15 bp, Homo sapiens
tgacagaatatgtgc

SEQ ID NO: 476702 - DNA, 15 bp, Homo sapiens
gacagaatatgtgcc

SEQ ID NO: 476703 - DNA, 15 bp, Homo sapiens
acagaatatgtgccc

SEQ ID NO: 476704 - DNA, 15 bp, Homo sapiens
cagaatatgtgccct

SEQ ID NO: 476705 - DNA, 15 bp, Homo sapiens
agaatatgtgccctt

SEQ ID NO: 476706 - DNA, 15 bp, Homo sapiens
gaatatgtgcccttt

SEQ ID NO: 476707 - DNA, 15 bp, Homo sapiens
aatatgtgccctttc

SEQ ID NO: 476708 - DNA, 15 bp, Homo sapiens
atatgtgccctttct

SEQ ID NO: 476709 - DNA, 15 bp, Homo sapiens
tatgtgccctttctg

SEQ ID NO: 476710 - DNA, 15 bp, Homo sapiens
atgtgccctttctgt

SEQ ID NO: 476711 - DNA, 15 bp, Homo sapiens
tgtgccctttctgtg

SEQ ID NO: 476712 - DNA, 15 bp, Homo sapiens
gtgccctttctgtga

SEQ ID NO: 476713 - DNA, 15 bp, Homo sapiens
tgccctttctgtgaa

SEQ ID NO: 476714 - DNA, 15 bp, Homo sapiens
gccctttctgtgaaa

SEQ ID NO: 476715 - DNA, 15 bp, Homo sapiens
ccctttctgtgaaat

SEQ ID NO: 476716 - DNA, 15 bp, Homo sapiens
cctttctgtgaaatc

SEQ ID NO: 476717 - DNA, 15 bp, Homo sapiens
ctttctgtgaaatcc

SEQ ID NO: 476718 - DNA, 15 bp, Homo sapiens
tttctgtgaaatcct

SEQ ID NO: 476719 - DNA, 15 bp, Homo sapiens
ttctgtgaaatcctc

SEQ ID NO: 476720 - DNA, 15 bp, Homo sapiens
tctgtgaaatcctct

SEQ ID NO: 476721 - DNA, 15 bp, Homo sapiens
ctgtgaaatcctctt

SEQ ID NO: 476722 - DNA, 15 bp, Homo sapiens
tgtgaaatcctcttt

SEQ ID NO: 476723 - DNA, 15 bp, Homo sapiens
gtgaaatcctctttc

SEQ ID NO: 476724 - DNA, 15 bp, Homo sapiens
tgaaatcctctttct

SEQ ID NO: 476725 - DNA, 15 bp, Homo sapiens
gaaatcctctttctt

SEQ ID NO: 476726 - DNA, 15 bp, Homo sapiens
aaatcctctttcttc

SEQ ID NO: 476727 - DNA, 15 bp, Homo sapiens
aatcctctttcttcc

SEQ ID NO: 476728 - DNA, 15 bp, Homo sapiens
atcctctttcttcca

SEQ ID NO: 476729 - DNA, 15 bp, Homo sapiens
tcctctttcttccac

SEQ ID NO: 476730 - DNA, 15 bp, Homo sapiens
cctctttcttccact

SEQ ID NO: 476731 - DNA, 15 bp, Homo sapiens
ctctttcttccacta

SEQ ID NO: 476732 - DNA, 15 bp, Homo sapiens
tctttcttccactag

SEQ ID NO: 476733 - DNA, 15 bp, Homo sapiens
ctttcttccactagc

SEQ ID NO: 476734 - DNA, 15 bp, Homo sapiens
tttcttccactagct

SEQ ID NO: 476735 - DNA, 15 bp, Homo sapiens
ttcttccactagcta

SEQ ID NO: 476736 - DNA, 15 bp, Homo sapiens
tcttccactagctaa

SEQ ID NO: 476737 - DNA, 15 bp, Homo sapiens
cttccactagctaac

SEQ ID NO: 476738 - DNA, 15 bp, Homo sapiens
ttccactagctaaca

SEQ ID NO: 476739 - DNA, 15 bp, Homo sapiens
tccactagctaacat

SEQ ID NO: 476740 - DNA, 15 bp, Homo sapiens
ccactagctaacatt

SEQ ID NO: 476741 - DNA, 15 bp, Homo sapiens
cactagctaacattt

SEQ ID NO: 476742 - DNA, 15 bp, Homo sapiens
actagctaacatttt

SEQ ID NO: 476743 - DNA, 15 bp, Homo sapiens
ctagctaacattttt

SEQ ID NO: 476744 - DNA, 15 bp, Homo sapiens
tagctaacatttttt

SEQ ID NO: 476745 - DNA, 15 bp, Homo sapiens
agctaacattttttc

SEQ ID NO: 476746 - DNA, 15 bp, Homo sapiens
gctaacattttttcc

SEQ ID NO: 476747 - DNA, 15 bp, Homo sapiens
ctaacattttttcca

SEQ ID NO: 476748 - DNA, 15 bp, Homo sapiens
taacattttttccat

SEQ ID NO: 476749 - DNA, 15 bp, Homo sapiens
aacattttttccata

SEQ ID NO: 476750 - DNA, 15 bp, Homo sapiens
acattttttccataa

SEQ ID NO: 476751 - DNA, 15 bp, Homo sapiens
cattttttccataat

SEQ ID NO: 476752 - DNA, 15 bp, Homo sapiens
attttttccataata

SEQ ID NO: 476753 - DNA, 15 bp, Homo sapiens
ttttttccataatat

SEQ ID NO: 476754 - DNA, 15 bp, Homo sapiens
tttttccataatatc

SEQ ID NO: 476755 - DNA, 15 bp, Homo sapiens
ttttccataatatct

SEQ ID NO: 476756 - DNA, 15 bp, Homo sapiens
tttccataatatctg

SEQ ID NO: 476757 - DNA, 15 bp, Homo sapiens
ttccataatatctgc

SEQ ID NO: 476758 - DNA, 15 bp, Homo sapiens
tccataatatctgca

SEQ ID NO: 476759 - DNA, 15 bp, Homo sapiens
ccataatatctgcat

SEQ ID NO: 476760 - DNA, 15 bp, Homo sapiens
cataatatctgcatt

SEQ ID NO: 476761 - DNA, 15 bp, Homo sapiens
ataatatctgcattt

SEQ ID NO: 476762 - DNA, 15 bp, Homo sapiens
taatatctgcattta

SEQ ID NO: 476763 - DNA, 15 bp, Homo sapiens
aatatctgcatttag

SEQ ID NO: 476764 - DNA, 15 bp, Homo sapiens
atatctgcatttagc

SEQ ID NO: 476765 - DNA, 15 bp, Homo sapiens
tatctgcatttagca

SEQ ID NO: 476766 - DNA, 15 bp, Homo sapiens
atctgcatttagcac

SEQ ID NO: 476767 - DNA, 15 bp, Homo sapiens
tctgcatttagcacc

SEQ ID NO: 476768 - DNA, 15 bp, Homo sapiens
ctgcatttagcacct

SEQ ID NO: 476769 - DNA, 15 bp, Homo sapiens
tgcatttagcacctc

SEQ ID NO: 476770 - DNA, 15 bp, Homo sapiens
gcatttagcacctct

SEQ ID NO: 476771 - DNA, 15 bp, Homo sapiens
catttagcacctctg

SEQ ID NO: 476772 - DNA, 15 bp, Homo sapiens
atttagcacctctga

SEQ ID NO: 476773 - DNA, 15 bp, Homo sapiens
tttagcacctctgac

SEQ ID NO: 476774 - DNA, 15 bp, Homo sapiens
ttagcacctctgacc

SEQ ID NO: 476775 - DNA, 15 bp, Homo sapiens
tagcacctctgaccc

SEQ ID NO: 476776 - DNA, 15 bp, Homo sapiens
agcacctctgaccca

SEQ ID NO: 476777 - DNA, 15 bp, Homo sapiens
gcacctctgacccac

SEQ ID NO: 476778 - DNA, 15 bp, Homo sapiens
cacctctgacccaca

SEQ ID NO: 476779 - DNA, 15 bp, Homo sapiens
acctctgacccacac

SEQ ID NO: 476780 - DNA, 15 bp, Homo sapiens
cctctgacccacaca

SEQ ID NO: 476781 - DNA, 15 bp, Homo sapiens
ctctgacccacacat

SEQ ID NO: 476782 - DNA, 15 bp, Homo sapiens
tctgacccacacata

SEQ ID NO: 476783 - DNA, 15 bp, Homo sapiens
ctgacccacacatac

SEQ ID NO: 476784 - DNA, 15 bp, Homo sapiens
tgacccacacatact

SEQ ID NO: 476785 - DNA, 15 bp, Homo sapiens
gacccacacatactt

SEQ ID NO: 476786 - DNA, 15 bp, Homo sapiens
acccacacatactta

SEQ ID NO: 476787 - DNA, 15 bp, Homo sapiens
cccacacatacttag

SEQ ID NO: 476788 - DNA, 15 bp, Homo sapiens
ccacacatacttaga

SEQ ID NO: 476789 - DNA, 15 bp, Homo sapiens
cacacatacttagat

SEQ ID NO: 476790 - DNA, 15 bp, Homo sapiens
acacatacttagata

SEQ ID NO: 476791 - DNA, 15 bp, Homo sapiens
cacatacttagatat

SEQ ID NO: 476792 - DNA, 15 bp, Homo sapiens
acatacttagatata

SEQ ID NO: 476793 - DNA, 15 bp, Homo sapiens
catacttagatatat

SEQ ID NO: 476794 - DNA, 15 bp, Homo sapiens
atacttagatatata

SEQ ID NO: 476795 - DNA, 15 bp, Homo sapiens
tacttagatatatac

SEQ ID NO: 476796 - DNA, 15 bp, Homo sapiens
acttagatatatact

SEQ ID NO: 476797 - DNA, 15 bp, Homo sapiens
cttagatatatactc

SEQ ID NO: 476798 - DNA, 15 bp, Homo sapiens
ttagatatatactcc

SEQ ID NO: 476799 - DNA, 15 bp, Homo sapiens
tagatatatactcct

SEQ ID NO: 476800 - DNA, 15 bp, Homo sapiens
agatatatactccta

SEQ ID NO: 476801 - DNA, 15 bp, Homo sapiens
gatatatactcctac

SEQ ID NO: 476802 - DNA, 15 bp, Homo sapiens
atatatactcctacc

SEQ ID NO: 476803 - DNA, 15 bp, Homo sapiens
tatatactcctaccc

SEQ ID NO: 476804 - DNA, 15 bp, Homo sapiens
atatactcctaccct

SEQ ID NO: 476805 - DNA, 15 bp, Homo sapiens
tatactcctaccctt

SEQ ID NO: 476806 - DNA, 15 bp, Homo sapiens
atactcctacccttc

SEQ ID NO: 476807 - DNA, 15 bp, Homo sapiens
tactcctacccttca

SEQ ID NO: 476808 - DNA, 15 bp, Homo sapiens
actcctacccttcat

SEQ ID NO: 476809 - DNA, 15 bp, Homo sapiens
ctcctacccttcatt

SEQ ID NO: 476810 - DNA, 15 bp, Homo sapiens
tcctacccttcattg

SEQ ID NO: 476811 - DNA, 15 bp, Homo sapiens
cctacccttcattga

SEQ ID NO: 476812 - DNA, 15 bp, Homo sapiens
ctacccttcattgaa

SEQ ID NO: 476813 - DNA, 15 bp, Homo sapiens
tacccttcattgaaa

SEQ ID NO: 476814 - DNA, 15 bp, Homo sapiens
acccttcattgaaaa

SEQ ID NO: 476815 - DNA, 15 bp, Homo sapiens
cccttcattgaaaac

SEQ ID NO: 476816 - DNA, 15 bp, Homo sapiens
ccttcattgaaaact

SEQ ID NO: 476817 - DNA, 15 bp, Homo sapiens
cttcattgaaaactg

SEQ ID NO: 476818 - DNA, 15 bp, Homo sapiens
ttcattgaaaactgt

SEQ ID NO: 476819 - DNA, 15 bp, Homo sapiens
tcattgaaaactgtt

SEQ ID NO: 476820 - DNA, 15 bp, Homo sapiens
cattgaaaactgtta

SEQ ID NO: 476821 - DNA, 15 bp, Homo sapiens
attgaaaactgttaa

SEQ ID NO: 476822 - DNA, 15 bp, Homo sapiens
ttgaaaactgttaac

SEQ ID NO: 476823 - DNA, 15 bp, Homo sapiens
tgaaaactgttaact

SEQ ID NO: 476824 - DNA, 15 bp, Homo sapiens
gaaaactgttaactc

SEQ ID NO: 476825 - DNA, 15 bp, Homo sapiens
aaaactgttaactcc

SEQ ID NO: 476826 - DNA, 15 bp, Homo sapiens
aaactgttaactcct

SEQ ID NO: 476827 - DNA, 15 bp, Homo sapiens
aactgttaactcctc

SEQ ID NO: 476828 - DNA, 15 bp, Homo sapiens
actgttaactcctct

SEQ ID NO: 476829 - DNA, 15 bp, Homo sapiens
ctgttaactcctctg

SEQ ID NO: 476830 - DNA, 15 bp, Homo sapiens
tgttaactcctctgc

SEQ ID NO: 476831 - DNA, 15 bp, Homo sapiens
gttaactcctctgcc

SEQ ID NO: 476832 - DNA, 15 bp, Homo sapiens
ttaactcctctgcca

SEQ ID NO: 476833 - DNA, 15 bp, Homo sapiens
taactcctctgccaa

SEQ ID NO: 476834 - DNA, 15 bp, Homo sapiens
aactcctctgccaat

SEQ ID NO: 476835 - DNA, 15 bp, Homo sapiens
actcctctgccaata

SEQ ID NO: 476836 - DNA, 15 bp, Homo sapiens
ctcctctgccaatat

SEQ ID NO: 476837 - DNA, 15 bp, Homo sapiens
tcctctgccaatatt

SEQ ID NO: 476838 - DNA, 15 bp, Homo sapiens
cctctgccaatattt

SEQ ID NO: 476839 - DNA, 15 bp, Homo sapiens
ctctgccaatatttt

SEQ ID NO: 476840 - DNA, 15 bp, Homo sapiens
tctgccaatatttta

SEQ ID NO: 476841 - DNA, 15 bp, Homo sapiens
ctgccaatattttat

SEQ ID NO: 476842 - DNA, 15 bp, Homo sapiens
tgccaatattttatt

SEQ ID NO: 476843 - DNA, 15 bp, Homo sapiens
gccaatattttattt

SEQ ID NO: 476844 - DNA, 15 bp, Homo sapiens
ccaatattttatttt

SEQ ID NO: 476845 - DNA, 15 bp, Homo sapiens
caatattttatttta

SEQ ID NO: 476846 - DNA, 15 bp, Homo sapiens
attttattttattag

SEQ ID NO: 476847 - DNA, 15 bp, Homo sapiens
ttttattttattagc

SEQ ID NO: 476848 - DNA, 15 bp, Homo sapiens
tttattttattagca

SEQ ID NO: 476849 - DNA, 15 bp, Homo sapiens
ttattttattagcaa

SEQ ID NO: 476850 - DNA, 15 bp, Homo sapiens
tattttattagcaac

SEQ ID NO: 476851 - DNA, 15 bp, Homo sapiens
attttattagcaact

SEQ ID NO: 476852 - DNA, 15 bp, Homo sapiens
ttttattagcaacta

SEQ ID NO: 476853 - DNA, 15 bp, Homo sapiens
tttattagcaactaa

SEQ ID NO: 476854 - DNA, 15 bp, Homo sapiens
ttattagcaactaag

SEQ ID NO: 476855 - DNA, 15 bp, Homo sapiens
tattagcaactaaga

SEQ ID NO: 476856 - DNA, 15 bp, Homo sapiens
attagcaactaagaa

SEQ ID NO: 476857 - DNA, 15 bp, Homo sapiens
ttagcaactaagaaa

SEQ ID NO: 476858 - DNA, 15 bp, Homo sapiens
tagcaactaagaaaa

SEQ ID NO: 476859 - DNA, 15 bp, Homo sapiens
agcaactaagaaaag

SEQ ID NO: 476860 - DNA, 15 bp, Homo sapiens
gcaactaagaaaagc

SEQ ID NO: 476861 - DNA, 15 bp, Homo sapiens
caactaagaaaagcc

SEQ ID NO: 476862 - DNA, 15 bp, Homo sapiens
aactaagaaaagcct

SEQ ID NO: 476863 - DNA, 15 bp, Homo sapiens
actaagaaaagcctc

SEQ ID NO: 476864 - DNA, 15 bp, Homo sapiens
ctaagaaaagcctca

SEQ ID NO: 476865 - DNA, 15 bp, Homo sapiens
taagaaaagcctcat

SEQ ID NO: 476866 - DNA, 15 bp, Homo sapiens
aagaaaagcctcatt

SEQ ID NO: 476867 - DNA, 15 bp, Homo sapiens
agaaaagcctcattg

SEQ ID NO: 476868 - DNA, 15 bp, Homo sapiens
gaaaagcctcattga

SEQ ID NO: 476869 - DNA, 15 bp, Homo sapiens
aaaagcctcattgac

SEQ ID NO: 476870 - DNA, 15 bp, Homo sapiens
aaagcctcattgact

SEQ ID NO: 476871 - DNA, 15 bp, Homo sapiens
aagcctcattgactt

SEQ ID NO: 476872 - DNA, 15 bp, Homo sapiens
agcctcattgacttt

SEQ ID NO: 476873 - DNA, 15 bp, Homo sapiens
gcctcattgacttta

SEQ ID NO: 476874 - DNA, 15 bp, Homo sapiens
cctcattgactttag

SEQ ID NO: 476875 - DNA, 15 bp, Homo sapiens
ctcattgactttaga

SEQ ID NO: 476876 - DNA, 15 bp, Homo sapiens
tcattgactttagaa

SEQ ID NO: 476877 - DNA, 15 bp, Homo sapiens
cattgactttagaat

SEQ ID NO: 476878 - DNA, 15 bp, Homo sapiens
attgactttagaata

SEQ ID NO: 476879 - DNA, 15 bp, Homo sapiens
ttgactttagaatac

SEQ ID NO: 476880 - DNA, 15 bp, Homo sapiens
tgactttagaatact

SEQ ID NO: 476881 - DNA, 15 bp, Homo sapiens
gactttagaatacta

SEQ ID NO: 476882 - DNA, 15 bp, Homo sapiens
actttagaatactaa

SEQ ID NO: 476883 - DNA, 15 bp, Homo sapiens
ctttagaatactaaa

SEQ ID NO: 476884 - DNA, 15 bp, Homo sapiens
tttagaatactaaaa

SEQ ID NO: 476885 - DNA, 15 bp, Homo sapiens
ttagaatactaaaaa

SEQ ID NO: 476886 - DNA, 15 bp, Homo sapiens
tagaatactaaaaag

SEQ ID NO: 476887 - DNA, 15 bp, Homo sapiens
agaatactaaaaaga

SEQ ID NO: 476888 - DNA, 15 bp, Homo sapiens
gaatactaaaaagat

SEQ ID NO: 476889 - DNA, 15 bp, Homo sapiens
aatactaaaaagata

SEQ ID NO: 476890 - DNA, 15 bp, Homo sapiens
atactaaaaagatat

SEQ ID NO: 476891 - DNA, 15 bp, Homo sapiens
tactaaaaagatatt

SEQ ID NO: 476892 - DNA, 15 bp, Homo sapiens
actaaaaagatatta

SEQ ID NO: 476893 - DNA, 15 bp, Homo sapiens
ctaaaaagatattat

SEQ ID NO: 476894 - DNA, 15 bp, Homo sapiens
taaaaagatattata

SEQ ID NO: 476895 - DNA, 15 bp, Homo sapiens
aaaaagatattatat

SEQ ID NO: 476896 - DNA, 15 bp, Homo sapiens
aaaagatattatata

SEQ ID NO: 476897 - DNA, 15 bp, Homo sapiens
aaagatattatatac

SEQ ID NO: 476898 - DNA, 15 bp, Homo sapiens
aagatattatatact

SEQ ID NO: 476899 - DNA, 15 bp, Homo sapiens
agatattatatacta

SEQ ID NO: 476900 - DNA, 15 bp, Homo sapiens
gatattatatactaa

SEQ ID NO: 476901 - DNA, 15 bp, Homo sapiens
atattatatactaaa

SEQ ID NO: 476902 - DNA, 15 bp, Homo sapiens
tattatatactaaaa

SEQ ID NO: 476903 - DNA, 15 bp, Homo sapiens
attatatactaaaaa

SEQ ID NO: 476904 - DNA, 15 bp, Homo sapiens
ttatatactaaaaag

SEQ ID NO: 476905 - DNA, 15 bp, Homo sapiens
tatatactaaaaagc

SEQ ID NO: 476906 - DNA, 15 bp, Homo sapiens
atatactaaaaagct

SEQ ID NO: 476907 - DNA, 15 bp, Homo sapiens
tatactaaaaagctt

SEQ ID NO: 476908 - DNA, 15 bp, Homo sapiens
atactaaaaagcttt

SEQ ID NO: 476909 - DNA, 15 bp, Homo sapiens
tactaaaaagctttc

SEQ ID NO: 476910 - DNA, 15 bp, Homo sapiens
actaaaaagctttct

SEQ ID NO: 476911 - DNA, 15 bp, Homo sapiens
ctaaaaagctttcta

SEQ ID NO: 476912 - DNA, 15 bp, Homo sapiens
taaaaagctttctag

SEQ ID NO: 476913 - DNA, 15 bp, Homo sapiens
aaaaagctttctagc

SEQ ID NO: 476914 - DNA, 15 bp, Homo sapiens
aaaagctttctagcc

SEQ ID NO: 476915 - DNA, 15 bp, Homo sapiens
aaagctttctagcca

SEQ ID NO: 476916 - DNA, 15 bp, Homo sapiens
aagctttctagccaa

SEQ ID NO: 476917 - DNA, 15 bp, Homo sapiens
agctttctagccaat

SEQ ID NO: 476918 - DNA, 15 bp, Homo sapiens
gctttctagccaatt

SEQ ID NO: 476919 - DNA, 15 bp, Homo sapiens
ctttctagccaatta

SEQ ID NO: 476920 - DNA, 15 bp, Homo sapiens
tttctagccaattag

SEQ ID NO: 476921 - DNA, 15 bp, Homo sapiens
ttctagccaattagt

SEQ ID NO: 476922 - DNA, 15 bp, Homo sapiens
tctagccaattagtt

SEQ ID NO: 476923 - DNA, 15 bp, Homo sapiens
ctagccaattagttt

SEQ ID NO: 476924 - DNA, 15 bp, Homo sapiens
tagccaattagttta

SEQ ID NO: 476925 - DNA, 15 bp, Homo sapiens
agccaattagtttat

SEQ ID NO: 476926 - DNA, 15 bp, Homo sapiens
gccaattagtttatt

SEQ ID NO: 476927 - DNA, 15 bp, Homo sapiens
ccaattagtttattt

SEQ ID NO: 476928 - DNA, 15 bp, Homo sapiens
caattagtttatttc

SEQ ID NO: 476929 - DNA, 15 bp, Homo sapiens
aattagtttatttct

SEQ ID NO: 476930 - DNA, 15 bp, Homo sapiens
attagtttatttctg

SEQ ID NO: 476931 - DNA, 15 bp, Homo sapiens
ttagtttatttctga

SEQ ID NO: 476932 - DNA, 15 bp, Homo sapiens
tagtttatttctgat

SEQ ID NO: 476933 - DNA, 15 bp, Homo sapiens
agtttatttctgatt

SEQ ID NO: 476934 - DNA, 15 bp, Homo sapiens
gtttatttctgattt

SEQ ID NO: 476935 - DNA, 15 bp, Homo sapiens
tttatttctgatttc

SEQ ID NO: 476936 - DNA, 15 bp, Homo sapiens
ttatttctgatttcc

SEQ ID NO: 476937 - DNA, 15 bp, Homo sapiens
tatttctgatttccc

SEQ ID NO: 476938 - DNA, 15 bp, Homo sapiens
atttctgatttcccc

SEQ ID NO: 476939 - DNA, 15 bp, Homo sapiens
tttctgatttcccca

SEQ ID NO: 476940 - DNA, 15 bp, Homo sapiens
ttctgatttccccat

SEQ ID NO: 476941 - DNA, 15 bp, Homo sapiens
tctgatttccccata

SEQ ID NO: 476942 - DNA, 15 bp, Homo sapiens
ctgatttccccatat

SEQ ID NO: 476943 - DNA, 15 bp, Homo sapiens
tgatttccccatatg

SEQ ID NO: 476944 - DNA, 15 bp, Homo sapiens
gatttccccatatgt

SEQ ID NO: 476945 - DNA, 15 bp, Homo sapiens
atttccccatatgtg

SEQ ID NO: 476946 - DNA, 15 bp, Homo sapiens
tttccccatatgtgt

SEQ ID NO: 476947 - DNA, 15 bp, Homo sapiens
ttccccatatgtgta

SEQ ID NO: 476948 - DNA, 15 bp, Homo sapiens
tccccatatgtgtat

SEQ ID NO: 476949 - DNA, 15 bp, Homo sapiens
ccccatatgtgtata

SEQ ID NO: 476950 - DNA, 15 bp, Homo sapiens
cccatatgtgtatat

SEQ ID NO: 476951 - DNA, 15 bp, Homo sapiens
ccatatgtgtatatt

SEQ ID NO: 476952 - DNA, 15 bp, Homo sapiens
catatgtgtatattc

SEQ ID NO: 476953 - DNA, 15 bp, Homo sapiens
atatgtgtatattcc

SEQ ID NO: 476954 - DNA, 15 bp, Homo sapiens
tatgtgtatattcca

SEQ ID NO: 476955 - DNA, 15 bp, Homo sapiens
atgtgtatattccac

SEQ ID NO: 476956 - DNA, 15 bp, Homo sapiens
tgtgtatattccact

SEQ ID NO: 476957 - DNA, 15 bp, Homo sapiens
gtgtatattccactt

SEQ ID NO: 476958 - DNA, 15 bp, Homo sapiens
tgtatattccacttg

SEQ ID NO: 476959 - DNA, 15 bp, Homo sapiens
gtatattccacttgg

SEQ ID NO: 476960 - DNA, 15 bp, Homo sapiens
tatattccacttggt

SEQ ID NO: 476961 - DNA, 15 bp, Homo sapiens
atattccacttggtt

SEQ ID NO: 476962 - DNA, 15 bp, Homo sapiens
tattccacttggttg

SEQ ID NO: 476963 - DNA, 15 bp, Homo sapiens
attccacttggttgt

SEQ ID NO: 476964 - DNA, 15 bp, Homo sapiens
ttccacttggttgtg

SEQ ID NO: 476965 - DNA, 15 bp, Homo sapiens
tccacttggttgtgg

SEQ ID NO: 476966 - DNA, 15 bp, Homo sapiens
ccacttggttgtgga

SEQ ID NO: 476967 - DNA, 15 bp, Homo sapiens
cacttggttgtggaa

SEQ ID NO: 476968 - DNA, 15 bp, Homo sapiens
acttggttgtggaac

SEQ ID NO: 476969 - DNA, 15 bp, Homo sapiens
cttggttgtggaact

SEQ ID NO: 476970 - DNA, 15 bp, Homo sapiens
ttggttgtggaactt

SEQ ID NO: 476971 - DNA, 15 bp, Homo sapiens
tggttgtggaacttt

SEQ ID NO: 476972 - DNA, 15 bp, Homo sapiens
ggttgtggaactttc

SEQ ID NO: 476973 - DNA, 15 bp, Homo sapiens
gttgtggaactttct

SEQ ID NO: 476974 - DNA, 15 bp, Homo sapiens
ttgtggaactttctc

SEQ ID NO: 476975 - DNA, 15 bp, Homo sapiens
tgtggaactttctca

SEQ ID NO: 476976 - DNA, 15 bp, Homo sapiens
gtggaactttctcag

SEQ ID NO: 476977 - DNA, 15 bp, Homo sapiens
tggaactttctcagc

SEQ ID NO: 476978 - DNA, 15 bp, Homo sapiens
ggaactttctcagca

SEQ ID NO: 476979 - DNA, 15 bp, Homo sapiens
gaactttctcagcaa

SEQ ID NO: 476980 - DNA, 15 bp, Homo sapiens
aactttctcagcaaa

SEQ ID NO: 476981 - DNA, 15 bp, Homo sapiens
actttctcagcaaat

SEQ ID NO: 476982 - DNA, 15 bp, Homo sapiens
ctttctcagcaaata

SEQ ID NO: 476983 - DNA, 15 bp, Homo sapiens
tttctcagcaaatat

SEQ ID NO: 476984 - DNA, 15 bp, Homo sapiens
ttctcagcaaatatt

SEQ ID NO: 476985 - DNA, 15 bp, Homo sapiens
tctcagcaaatattt

SEQ ID NO: 476986 - DNA, 15 bp, Homo sapiens
ctcagcaaatatttt

SEQ ID NO: 476987 - DNA, 15 bp, Homo sapiens
tcagcaaatatttta

SEQ ID NO: 476988 - DNA, 15 bp, Homo sapiens
cagcaaatattttat

SEQ ID NO: 476989 - DNA, 15 bp, Homo sapiens
agcaaatattttatc

SEQ ID NO: 476990 - DNA, 15 bp, Homo sapiens
gcaaatattttatca

SEQ ID NO: 476991 - DNA, 15 bp, Homo sapiens
caaatattttatcac

SEQ ID NO: 476992 - DNA, 15 bp, Homo sapiens
aaatattttatcact

SEQ ID NO: 476993 - DNA, 15 bp, Homo sapiens
aatattttatcactg

SEQ ID NO: 476994 - DNA, 15 bp, Homo sapiens
atattttatcactga

SEQ ID NO: 476995 - DNA, 15 bp, Homo sapiens
tattttatcactgat

SEQ ID NO: 476996 - DNA, 15 bp, Homo sapiens
attttatcactgatt

SEQ ID NO: 476997 - DNA, 15 bp, Homo sapiens
ttttatcactgatta

SEQ ID NO: 476998 - DNA, 15 bp, Homo sapiens
tttatcactgattat

SEQ ID NO: 476999 - DNA, 15 bp, Homo sapiens
ttatcactgattatc

SEQ ID NO: 477000 - DNA, 15 bp, Homo sapiens
tatcactgattatcc

SEQ ID NO: 477001 - DNA, 15 bp, Homo sapiens
atcactgattatccc

SEQ ID NO: 477002 - DNA, 15 bp, Homo sapiens
tcactgattatccca

SEQ ID NO: 477003 - DNA, 15 bp, Homo sapiens
cactgattatcccac

SEQ ID NO: 477004 - DNA, 15 bp, Homo sapiens
actgattatcccact

SEQ ID NO: 477005 - DNA, 15 bp, Homo sapiens
ctgattatcccacta

SEQ ID NO: 477006 - DNA, 15 bp, Homo sapiens
tgattatcccactat

SEQ ID NO: 477007 - DNA, 15 bp, Homo sapiens
gattatcccactatt

SEQ ID NO: 477008 - DNA, 15 bp, Homo sapiens
attatcccactattg

SEQ ID NO: 477009 - DNA, 15 bp, Homo sapiens
ttatcccactattgt

SEQ ID NO: 477010 - DNA, 15 bp, Homo sapiens
tatcccactattgtg

SEQ ID NO: 477011 - DNA, 15 bp, Homo sapiens
atcccactattgtgt

SEQ ID NO: 477012 - DNA, 15 bp, Homo sapiens
tcccactattgtgtg

SEQ ID NO: 477013 - DNA, 15 bp, Homo sapiens
cccactattgtgtgt

SEQ ID NO: 477014 - DNA, 15 bp, Homo sapiens
ccactattgtgtgta

SEQ ID NO: 477015 - DNA, 15 bp, Homo sapiens
cactattgtgtgtac

SEQ ID NO: 477016 - DNA, 15 bp, Homo sapiens
actattgtgtgtact

SEQ ID NO: 477017 - DNA, 15 bp, Homo sapiens
ctattgtgtgtactc

SEQ ID NO: 477018 - DNA, 15 bp, Homo sapiens
tattgtgtgtactct

SEQ ID NO: 477019 - DNA, 15 bp, Homo sapiens
attgtgtgtactctt

SEQ ID NO: 477020 - DNA, 15 bp, Homo sapiens
ttgtgtgtactctta

SEQ ID NO: 477021 - DNA, 15 bp, Homo sapiens
tgtgtgtactcttac

SEQ ID NO: 477022 - DNA, 15 bp, Homo sapiens
gtgtgtactcttact

SEQ ID NO: 477023 - DNA, 15 bp, Homo sapiens
tgtgtactcttactt

SEQ ID NO: 477024 - DNA, 15 bp, Homo sapiens
gtgtactcttacttt

SEQ ID NO: 477025 - DNA, 15 bp, Homo sapiens
tgtactcttactttt

SEQ ID NO: 477026 - DNA, 15 bp, Homo sapiens
gtactcttacttttg

SEQ ID NO: 477027 - DNA, 15 bp, Homo sapiens
tactcttacttttgg

SEQ ID NO: 477028 - DNA, 15 bp, Homo sapiens
actcttacttttgga

SEQ ID NO: 477029 - DNA, 15 bp, Homo sapiens
ctcttacttttggaa

SEQ ID NO: 477030 - DNA, 15 bp, Homo sapiens
tcttacttttggaac

SEQ ID NO: 477031 - DNA, 15 bp, Homo sapiens
cttacttttggaact

SEQ ID NO: 477032 - DNA, 15 bp, Homo sapiens
ttacttttggaactt

SEQ ID NO: 477033 - DNA, 15 bp, Homo sapiens
tacttttggaacttt

SEQ ID NO: 477034 - DNA, 15 bp, Homo sapiens
acttttggaactttt

SEQ ID NO: 477035 - DNA, 15 bp, Homo sapiens
cttttggaacttttt

SEQ ID NO: 477036 - DNA, 15 bp, Homo sapiens
ttttggaacttttta

SEQ ID NO: 477037 - DNA, 15 bp, Homo sapiens
tttggaactttttat

SEQ ID NO: 477038 - DNA, 15 bp, Homo sapiens
ttggaactttttatt

SEQ ID NO: 477039 - DNA, 15 bp, Homo sapiens
tggaactttttattc

SEQ ID NO: 477040 - DNA, 15 bp, Homo sapiens
ggaactttttattct

SEQ ID NO: 477041 - DNA, 15 bp, Homo sapiens
gaactttttattctt

SEQ ID NO: 477042 - DNA, 15 bp, Homo sapiens
aactttttattcttt

SEQ ID NO: 477043 - DNA, 15 bp, Homo sapiens
actttttattctttt

SEQ ID NO: 477044 - DNA, 15 bp, Homo sapiens
ctttttattcttttt

SEQ ID NO: 477045 - DNA, 15 bp, Homo sapiens
tttttattctttttt

SEQ ID NO: 477046 - DNA, 15 bp, Homo sapiens
ttttattcttttttt

SEQ ID NO: 477047 - DNA, 15 bp, Homo sapiens
ttattcttttttttg

SEQ ID NO: 477048 - DNA, 15 bp, Homo sapiens
tattcttttttttgt

SEQ ID NO: 477049 - DNA, 15 bp, Homo sapiens
attcttttttttgtg

SEQ ID NO: 477050 - DNA, 15 bp, Homo sapiens
ttcttttttttgtgc

SEQ ID NO: 477051 - DNA, 15 bp, Homo sapiens
tcttttttttgtgcc

SEQ ID NO: 477052 - DNA, 15 bp, Homo sapiens
cttttttttgtgccc

SEQ ID NO: 477053 - DNA, 15 bp, Homo sapiens
ttttttttgtgccct

SEQ ID NO: 477054 - DNA, 15 bp, Homo sapiens
tttttttgtgccctg

SEQ ID NO: 477055 - DNA, 15 bp, Homo sapiens
ttttttgtgccctgg

SEQ ID NO: 477056 - DNA, 15 bp, Homo sapiens
tttttgtgccctgga

SEQ ID NO: 477057 - DNA, 15 bp, Homo sapiens
ttttgtgccctggaa

SEQ ID NO: 477058 - DNA, 15 bp, Homo sapiens
tttgtgccctggaat

SEQ ID NO: 477059 - DNA, 15 bp, Homo sapiens
ttgtgccctggaatt

SEQ ID NO: 477060 - DNA, 15 bp, Homo sapiens
tgtgccctggaattc

SEQ ID NO: 477061 - DNA, 15 bp, Homo sapiens
gtgccctggaattca

SEQ ID NO: 477062 - DNA, 15 bp, Homo sapiens
tgccctggaattcac

SEQ ID NO: 477063 - DNA, 15 bp, Homo sapiens
gccctggaattcaca

SEQ ID NO: 477064 - DNA, 15 bp, Homo sapiens
ccctggaattcacat

SEQ ID NO: 477065 - DNA, 15 bp, Homo sapiens
cctggaattcacatt

SEQ ID NO: 477066 - DNA, 15 bp, Homo sapiens
ctggaattcacattt

SEQ ID NO: 477067 - DNA, 15 bp, Homo sapiens
tggaattcacatttt

SEQ ID NO: 477068 - DNA, 15 bp, Homo sapiens
ggaattcacattttt

SEQ ID NO: 477069 - DNA, 15 bp, Homo sapiens
gaattcacattttta

SEQ ID NO: 477070 - DNA, 15 bp, Homo sapiens
aattcacatttttaa

SEQ ID NO: 477071 - DNA, 15 bp, Homo sapiens
attcacatttttaat

SEQ ID NO: 477072 - DNA, 15 bp, Homo sapiens
ttcacatttttaatc

SEQ ID NO: 477073 - DNA, 15 bp, Homo sapiens
tcacatttttaatcc

SEQ ID NO: 477074 - DNA, 15 bp, Homo sapiens
cacatttttaatcct

SEQ ID NO: 477075 - DNA, 15 bp, Homo sapiens
acatttttaatcctg

SEQ ID NO: 477076 - DNA, 15 bp, Homo sapiens
catttttaatcctga

SEQ ID NO: 477077 - DNA, 15 bp, Homo sapiens
atttttaatcctgaa

SEQ ID NO: 477078 - DNA, 15 bp, Homo sapiens
tttttaatcctgaat

SEQ ID NO: 477079 - DNA, 15 bp, Homo sapiens
ttttaatcctgaata

SEQ ID NO: 477080 - DNA, 15 bp, Homo sapiens
tttaatcctgaataa

SEQ ID NO: 477081 - DNA, 15 bp, Homo sapiens
ttaatcctgaataat

SEQ ID NO: 477082 - DNA, 15 bp, Homo sapiens
taatcctgaataata

SEQ ID NO: 477083 - DNA, 15 bp, Homo sapiens
aatcctgaataatat

SEQ ID NO: 477084 - DNA, 15 bp, Homo sapiens
atcctgaataatatc

SEQ ID NO: 477085 - DNA, 15 bp, Homo sapiens
tcctgaataatatct

SEQ ID NO: 477086 - DNA, 15 bp, Homo sapiens
cctgaataatatcta

SEQ ID NO: 477087 - DNA, 15 bp, Homo sapiens
ctgaataatatctaa

SEQ ID NO: 477088 - DNA, 15 bp, Homo sapiens
gaataatatctaaaa

SEQ ID NO: 477089 - DNA, 15 bp, Homo sapiens
aataatatctaaaag

SEQ ID NO: 477090 - DNA, 15 bp, Homo sapiens
ataatatctaaaaga

SEQ ID NO: 477091 - DNA, 15 bp, Homo sapiens
taatatctaaaagac

SEQ ID NO: 477092 - DNA, 15 bp, Homo sapiens
aatatctaaaagact

SEQ ID NO: 477093 - DNA, 15 bp, Homo sapiens
atatctaaaagacta

SEQ ID NO: 477094 - DNA, 15 bp, Homo sapiens
tatctaaaagactaa

SEQ ID NO: 477095 - DNA, 15 bp, Homo sapiens
atctaaaagactaat

SEQ ID NO: 477096 - DNA, 15 bp, Homo sapiens
tctaaaagactaata

SEQ ID NO: 477097 - DNA, 15 bp, Homo sapiens
ctaaaagactaatac

SEQ ID NO: 477098 - DNA, 15 bp, Homo sapiens
taaaagactaatact

SEQ ID NO: 477099 - DNA, 15 bp, Homo sapiens
aaaagactaatactg

SEQ ID NO: 477100 - DNA, 15 bp, Homo sapiens
aaagactaatactgt

SEQ ID NO: 477101 - DNA, 15 bp, Homo sapiens
aagactaatactgtc

SEQ ID NO: 477102 - DNA, 15 bp, Homo sapiens
agactaatactgtca

SEQ ID NO: 477103 - DNA, 15 bp, Homo sapiens
gactaatactgtcaa

SEQ ID NO: 477104 - DNA, 15 bp, Homo sapiens
actaatactgtcaag

SEQ ID NO: 477105 - DNA, 15 bp, Homo sapiens
ctaatactgtcaagc

SEQ ID NO: 477106 - DNA, 15 bp, Homo sapiens
taatactgtcaagct

SEQ ID NO: 477107 - DNA, 15 bp, Homo sapiens
aatactgtcaagctt

SEQ ID NO: 477108 - DNA, 15 bp, Homo sapiens
atactgtcaagctta

SEQ ID NO: 477109 - DNA, 15 bp, Homo sapiens
tactgtcaagcttat

SEQ ID NO: 477110 - DNA, 15 bp, Homo sapiens
actgtcaagcttatg

SEQ ID NO: 477111 - DNA, 15 bp, Homo sapiens
ctgtcaagcttatgt

SEQ ID NO: 477112 - DNA, 15 bp, Homo sapiens
tgtcaagcttatgtg

SEQ ID NO: 477113 - DNA, 15 bp, Homo sapiens
gtcaagcttatgtga

SEQ ID NO: 477114 - DNA, 15 bp, Homo sapiens
tcaagcttatgtgac

SEQ ID NO: 477115 - DNA, 15 bp, Homo sapiens
caagcttatgtgact

SEQ ID NO: 477116 - DNA, 15 bp, Homo sapiens
aagcttatgtgacta

SEQ ID NO: 477117 - DNA, 15 bp, Homo sapiens
agcttatgtgactaa

SEQ ID NO: 477118 - DNA, 15 bp, Homo sapiens
gcttatgtgactaac

SEQ ID NO: 477119 - DNA, 15 bp, Homo sapiens
cttatgtgactaaca

SEQ ID NO: 477120 - DNA, 15 bp, Homo sapiens
ttatgtgactaacaa

SEQ ID NO: 477121 - DNA, 15 bp, Homo sapiens
tatgtgactaacaaa

SEQ ID NO: 477122 - DNA, 15 bp, Homo sapiens
atgtgactaacaaag

SEQ ID NO: 477123 - DNA, 15 bp, Homo sapiens
tgtgactaacaaagc

SEQ ID NO: 477124 - DNA, 15 bp, Homo sapiens
gtgactaacaaagct

SEQ ID NO: 477125 - DNA, 15 bp, Homo sapiens
tgactaacaaagctc

SEQ ID NO: 477126 - DNA, 15 bp, Homo sapiens
gactaacaaagctct

SEQ ID NO: 477127 - DNA, 15 bp, Homo sapiens
actaacaaagctcta

SEQ ID NO: 477128 - DNA, 15 bp, Homo sapiens
ctaacaaagctctat

SEQ ID NO: 477129 - DNA, 15 bp, Homo sapiens
taacaaagctctatt

SEQ ID NO: 477130 - DNA, 15 bp, Homo sapiens
aacaaagctctattg

SEQ ID NO: 477131 - DNA, 15 bp, Homo sapiens
acaaagctctattgt

SEQ ID NO: 477132 - DNA, 15 bp, Homo sapiens
caaagctctattgtg

SEQ ID NO: 477133 - DNA, 15 bp, Homo sapiens
aaagctctattgtgg

SEQ ID NO: 477134 - DNA, 15 bp, Homo sapiens
aagctctattgtggt

SEQ ID NO: 477135 - DNA, 15 bp, Homo sapiens
agctctattgtggtt

SEQ ID NO: 477136 - DNA, 15 bp, Homo sapiens
gctctattgtggttt

SEQ ID NO: 477137 - DNA, 15 bp, Homo sapiens
ctctattgtggtttg

SEQ ID NO: 477138 - DNA, 15 bp, Homo sapiens
tctattgtggtttgg

SEQ ID NO: 477139 - DNA, 15 bp, Homo sapiens
ctattgtggtttgga

SEQ ID NO: 477140 - DNA, 15 bp, Homo sapiens
tattgtggtttggat

SEQ ID NO: 477141 - DNA, 15 bp, Homo sapiens
attgtggtttggatc

SEQ ID NO: 477142 - DNA, 15 bp, Homo sapiens
ttgtggtttggatct

SEQ ID NO: 477143 - DNA, 15 bp, Homo sapiens
tgtggtttggatctg

SEQ ID NO: 477144 - DNA, 15 bp, Homo sapiens
gtggtttggatctga

SEQ ID NO: 477145 - DNA, 15 bp, Homo sapiens
tggtttggatctgat

SEQ ID NO: 477146 - DNA, 15 bp, Homo sapiens
ggtttggatctgatg

SEQ ID NO: 477147 - DNA, 15 bp, Homo sapiens
gtttggatctgatgg

SEQ ID NO: 477148 - DNA, 15 bp, Homo sapiens
tttggatctgatggg

SEQ ID NO: 477149 - DNA, 15 bp, Homo sapiens
ttggatctgatggga

SEQ ID NO: 477150 - DNA, 15 bp, Homo sapiens
tggatctgatgggaa

SEQ ID NO: 477151 - DNA, 15 bp, Homo sapiens
ggatctgatgggaat

SEQ ID NO: 477152 - DNA, 15 bp, Homo sapiens
gatctgatgggaatc

SEQ ID NO: 477153 - DNA, 15 bp, Homo sapiens
atctgatgggaatct

SEQ ID NO: 477154 - DNA, 15 bp, Homo sapiens
tctgatgggaatctg

SEQ ID NO: 477155 - DNA, 15 bp, Homo sapiens
ctgatgggaatctgt

SEQ ID NO: 477156 - DNA, 15 bp, Homo sapiens
tgatgggaatctgta

SEQ ID NO: 477157 - DNA, 15 bp, Homo sapiens
gatgggaatctgtaa

SEQ ID NO: 477158 - DNA, 15 bp, Homo sapiens
atgggaatctgtaaa

SEQ ID NO: 477159 - DNA, 15 bp, Homo sapiens
tgggaatctgtaaag

SEQ ID NO: 477160 - DNA, 15 bp, Homo sapiens
gggaatctgtaaagt

SEQ ID NO: 477161 - DNA, 15 bp, Homo sapiens
ggaatctgtaaagta

SEQ ID NO: 477162 - DNA, 15 bp, Homo sapiens
gaatctgtaaagtag

SEQ ID NO: 477163 - DNA, 15 bp, Homo sapiens
aatctgtaaagtaga

SEQ ID NO: 477164 - DNA, 15 bp, Homo sapiens
atctgtaaagtagac

SEQ ID NO: 477165 - DNA, 15 bp, Homo sapiens
tctgtaaagtagaca

SEQ ID NO: 477166 - DNA, 15 bp, Homo sapiens
ctgtaaagtagacag

SEQ ID NO: 477167 - DNA, 15 bp, Homo sapiens
tgtaaagtagacaga

SEQ ID NO: 477168 - DNA, 15 bp, Homo sapiens
gtaaagtagacagaa

SEQ ID NO: 477169 - DNA, 15 bp, Homo sapiens
taaagtagacagaaa

SEQ ID NO: 477170 - DNA, 15 bp, Homo sapiens
aaagtagacagaaaa

SEQ ID NO: 477171 - DNA, 15 bp, Homo sapiens
aagtagacagaaaag

SEQ ID NO: 477172 - DNA, 15 bp, Homo sapiens
agtagacagaaaagt

SEQ ID NO: 477173 - DNA, 15 bp, Homo sapiens
gtagacagaaaagtt

SEQ ID NO: 477174 - DNA, 15 bp, Homo sapiens
tagacagaaaagttg

SEQ ID NO: 477175 - DNA, 15 bp, Homo sapiens
agacagaaaagttgt

SEQ ID NO: 477176 - DNA, 15 bp, Homo sapiens
gacagaaaagttgtc

SEQ ID NO: 477177 - DNA, 15 bp, Homo sapiens
acagaaaagttgtca

SEQ ID NO: 477178 - DNA, 15 bp, Homo sapiens
cagaaaagttgtcaa

SEQ ID NO: 477179 - DNA, 15 bp, Homo sapiens
agaaaagttgtcaaa

SEQ ID NO: 477180 - DNA, 15 bp, Homo sapiens
gaaaagttgtcaaac

SEQ ID NO: 477181 - DNA, 15 bp, Homo sapiens
aaaagttgtcaaaca

SEQ ID NO: 477182 - DNA, 15 bp, Homo sapiens
aaagttgtcaaacat

SEQ ID NO: 477183 - DNA, 15 bp, Homo sapiens
aagttgtcaaacata

SEQ ID NO: 477184 - DNA, 15 bp, Homo sapiens
agttgtcaaacatag

SEQ ID NO: 477185 - DNA, 15 bp, Homo sapiens
gttgtcaaacatagt

SEQ ID NO: 477186 - DNA, 15 bp, Homo sapiens
ttgtcaaacatagta

SEQ ID NO: 477187 - DNA, 15 bp, Homo sapiens
tgtcaaacatagtag

SEQ ID NO: 477188 - DNA, 15 bp, Homo sapiens
gtcaaacatagtagt

SEQ ID NO: 477189 - DNA, 15 bp, Homo sapiens
tcaaacatagtagtt

SEQ ID NO: 477190 - DNA, 15 bp, Homo sapiens
caaacatagtagttg

SEQ ID NO: 477191 - DNA, 15 bp, Homo sapiens
aaacatagtagttgg

SEQ ID NO: 477192 - DNA, 15 bp, Homo sapiens
aacatagtagttggg

SEQ ID NO: 477193 - DNA, 15 bp, Homo sapiens
acatagtagttgggt

SEQ ID NO: 477194 - DNA, 15 bp, Homo sapiens
catagtagttgggtg

SEQ ID NO: 477195 - DNA, 15 bp, Homo sapiens
atagtagttgggtgt

SEQ ID NO: 477196 - DNA, 15 bp, Homo sapiens
tagtagttgggtgtt

SEQ ID NO: 477197 - DNA, 15 bp, Homo sapiens
agtagttgggtgttt

SEQ ID NO: 477198 - DNA, 15 bp, Homo sapiens
gtagttgggtgtttt

SEQ ID NO: 477199 - DNA, 15 bp, Homo sapiens
tagttgggtgttttc

SEQ ID NO: 477200 - DNA, 15 bp, Homo sapiens
agttgggtgttttca

SEQ ID NO: 477201 - DNA, 15 bp, Homo sapiens
gttgggtgttttcac

SEQ ID NO: 477202 - DNA, 15 bp, Homo sapiens
ttgggtgttttcact

SEQ ID NO: 477203 - DNA, 15 bp, Homo sapiens
tgggtgttttcacta

SEQ ID NO: 477204 - DNA, 15 bp, Homo sapiens
gggtgttttcactaa

SEQ ID NO: 477205 - DNA, 15 bp, Homo sapiens
ggtgttttcactaaa

SEQ ID NO: 477206 - DNA, 15 bp, Homo sapiens
gtgttttcactaaaa

SEQ ID NO: 477207 - DNA, 15 bp, Homo sapiens
tgttttcactaaaaa

SEQ ID NO: 477208 - DNA, 15 bp, Homo sapiens
gttttcactaaaaaa

SEQ ID NO: 477209 - DNA, 15 bp, Homo sapiens
ttttcactaaaaaaa

SEQ ID NO: 477210 - DNA, 15 bp, Homo sapiens
tttcactaaaaaaaa

SEQ ID NO: 477211 - DNA, 15 bp, Homo sapiens
ttcactaaaaaaaaa

SEQ ID NO: 477212 - DNA, 15 bp, Homo sapiens
tcactaaaaaaaaaa

SEQ ID NO: 477213 - DNA, 15 bp, Homo sapiens
cactaaaaaaaaaaa

SEQ ID NO: 477214 - DNA, 15 bp, Homo sapiens
aaaaaaaaaaaacta

SEQ ID NO: 477215 - DNA, 15 bp, Homo sapiens
aaaaaaaaaactatg

SEQ ID NO: 477216 - DNA, 15 bp, Homo sapiens
aaaaaaaaactatgg

SEQ ID NO: 477217 - DNA, 15 bp, Homo sapiens
aaaaaaaactatgga

SEQ ID NO: 477218 - DNA, 15 bp, Homo sapiens
aaaaaaactatggag

SEQ ID NO: 477219 - DNA, 15 bp, Homo sapiens
aaaaaactatggaga

SEQ ID NO: 477220 - DNA, 15 bp, Homo sapiens
aaaaactatggagag

SEQ ID NO: 477221 - DNA, 15 bp, Homo sapiens
aaaactatggagagt

SEQ ID NO: 477222 - DNA, 15 bp, Homo sapiens
aaactatggagagtg

SEQ ID NO: 477223 - DNA, 15 bp, Homo sapiens
aactatggagagtgc

SEQ ID NO: 477224 - DNA, 15 bp, Homo sapiens
actatggagagtgct

SEQ ID NO: 477225 - DNA, 15 bp, Homo sapiens
ctatggagagtgcta

SEQ ID NO: 477226 - DNA, 15 bp, Homo sapiens
tatggagagtgctag

SEQ ID NO: 477227 - DNA, 15 bp, Homo sapiens
atggagagtgctagg

SEQ ID NO: 477228 - DNA, 15 bp, Homo sapiens
tggagagtgctaggt

SEQ ID NO: 477229 - DNA, 15 bp, Homo sapiens
ggagagtgctaggtt

SEQ ID NO: 477230 - DNA, 15 bp, Homo sapiens
gagagtgctaggtta

SEQ ID NO: 477231 - DNA, 15 bp, Homo sapiens
agagtgctaggttaa

SEQ ID NO: 477232 - DNA, 15 bp, Homo sapiens
gagtgctaggttaaa

SEQ ID NO: 477233 - DNA, 15 bp, Homo sapiens
agtgctaggttaaaa

SEQ ID NO: 477234 - DNA, 15 bp, Homo sapiens
gtgctaggttaaaat

SEQ ID NO: 477235 - DNA, 15 bp, Homo sapiens
tgctaggttaaaata

SEQ ID NO: 477236 - DNA, 15 bp, Homo sapiens
gctaggttaaaatac

SEQ ID NO: 477237 - DNA, 15 bp, Homo sapiens
ctaggttaaaatact

SEQ ID NO: 477238 - DNA, 15 bp, Homo sapiens
taggttaaaatactt

SEQ ID NO: 477239 - DNA, 15 bp, Homo sapiens
aggttaaaatactta

SEQ ID NO: 477240 - DNA, 15 bp, Homo sapiens
ggttaaaatacttaa

SEQ ID NO: 477241 - DNA, 15 bp, Homo sapiens
gttaaaatacttaaa

SEQ ID NO: 477242 - DNA, 15 bp, Homo sapiens
ttaaaatacttaaag

SEQ ID NO: 477243 - DNA, 15 bp, Homo sapiens
taaaatacttaaagt

SEQ ID NO: 477244 - DNA, 15 bp, Homo sapiens
aaaatacttaaagtg

SEQ ID NO: 477245 - DNA, 15 bp, Homo sapiens
aaatacttaaagtgc

SEQ ID NO: 477246 - DNA, 15 bp, Homo sapiens
aatacttaaagtgct

SEQ ID NO: 477247 - DNA, 15 bp, Homo sapiens
atacttaaagtgctc

SEQ ID NO: 477248 - DNA, 15 bp, Homo sapiens
tacttaaagtgctca

SEQ ID NO: 477249 - DNA, 15 bp, Homo sapiens
acttaaagtgctcaa

SEQ ID NO: 477250 - DNA, 15 bp, Homo sapiens
cttaaagtgctcaaa

SEQ ID NO: 477251 - DNA, 15 bp, Homo sapiens
ttaaagtgctcaaat

SEQ ID NO: 477252 - DNA, 15 bp, Homo sapiens
taaagtgctcaaata

SEQ ID NO: 477253 - DNA, 15 bp, Homo sapiens
aaagtgctcaaatat

SEQ ID NO: 477254 - DNA, 15 bp, Homo sapiens
aagtgctcaaatata

SEQ ID NO: 477255 - DNA, 15 bp, Homo sapiens
agtgctcaaatatag

SEQ ID NO: 477256 - DNA, 15 bp, Homo sapiens
gtgctcaaatataga

SEQ ID NO: 477257 - DNA, 15 bp, Homo sapiens
tgctcaaatatagaa

SEQ ID NO: 477258 - DNA, 15 bp, Homo sapiens
gctcaaatatagaat

SEQ ID NO: 477259 - DNA, 15 bp, Homo sapiens
ctcaaatatagaata

SEQ ID NO: 477260 - DNA, 15 bp, Homo sapiens
tcaaatatagaatat

SEQ ID NO: 477261 - DNA, 15 bp, Homo sapiens
caaatatagaatatt

SEQ ID NO: 477262 - DNA, 15 bp, Homo sapiens
aaatatagaatattc

SEQ ID NO: 477263 - DNA, 15 bp, Homo sapiens
aatatagaatattct

SEQ ID NO: 477264 - DNA, 15 bp, Homo sapiens
atatagaatattctc

SEQ ID NO: 477265 - DNA, 15 bp, Homo sapiens
tatagaatattctct

SEQ ID NO: 477266 - DNA, 15 bp, Homo sapiens
atagaatattctctt

SEQ ID NO: 477267 - DNA, 15 bp, Homo sapiens
tagaatattctcttt

SEQ ID NO: 477268 - DNA, 15 bp, Homo sapiens
agaatattctctttc

SEQ ID NO: 477269 - DNA, 15 bp, Homo sapiens
gaatattctctttcc

SEQ ID NO: 477270 - DNA, 15 bp, Homo sapiens
aatattctctttcca

SEQ ID NO: 477271 - DNA, 15 bp, Homo sapiens
atattctctttccat

SEQ ID NO: 477272 - DNA, 15 bp, Homo sapiens
tattctctttccata

SEQ ID NO: 477273 - DNA, 15 bp, Homo sapiens
attctctttccatat

SEQ ID NO: 477274 - DNA, 15 bp, Homo sapiens
ttctctttccatatt

SEQ ID NO: 477275 - DNA, 15 bp, Homo sapiens
tctctttccatattt

SEQ ID NO: 477276 - DNA, 15 bp, Homo sapiens
ctctttccatatttt

SEQ ID NO: 477277 - DNA, 15 bp, Homo sapiens
tctttccatattttc

SEQ ID NO: 477278 - DNA, 15 bp, Homo sapiens
ctttccatattttct

SEQ ID NO: 477279 - DNA, 15 bp, Homo sapiens
tttccatattttcta

SEQ ID NO: 477280 - DNA, 15 bp, Homo sapiens
ttccatattttctaa

SEQ ID NO: 477281 - DNA, 15 bp, Homo sapiens
tccatattttctaaa

SEQ ID NO: 477282 - DNA, 15 bp, Homo sapiens
ccatattttctaaaa

SEQ ID NO: 477283 - DNA, 15 bp, Homo sapiens
catattttctaaaac

SEQ ID NO: 477284 - DNA, 15 bp, Homo sapiens
atattttctaaaact

SEQ ID NO: 477285 - DNA, 15 bp, Homo sapiens
tattttctaaaactt

SEQ ID NO: 477286 - DNA, 15 bp, Homo sapiens
attttctaaaacttg

SEQ ID NO: 477287 - DNA, 15 bp, Homo sapiens
ttttctaaaacttgt

SEQ ID NO: 477288 - DNA, 15 bp, Homo sapiens
tttctaaaacttgtt

SEQ ID NO: 477289 - DNA, 15 bp, Homo sapiens
ttctaaaacttgttt

SEQ ID NO: 477290 - DNA, 15 bp, Homo sapiens
tctaaaacttgtttt

SEQ ID NO: 477291 - DNA, 15 bp, Homo sapiens
ctaaaacttgtttta

SEQ ID NO: 477292 - DNA, 15 bp, Homo sapiens
taaaacttgttttat

SEQ ID NO: 477293 - DNA, 15 bp, Homo sapiens
aaaacttgttttatt

SEQ ID NO: 477294 - DNA, 15 bp, Homo sapiens
aaacttgttttattt

SEQ ID NO: 477295 - DNA, 15 bp, Homo sapiens
aacttgttttattta

SEQ ID NO: 477296 - DNA, 15 bp, Homo sapiens
acttgttttatttat

SEQ ID NO: 477297 - DNA, 15 bp, Homo sapiens
cttgttttatttatt

SEQ ID NO: 477298 - DNA, 15 bp, Homo sapiens
ttgttttatttatta

SEQ ID NO: 477299 - DNA, 15 bp, Homo sapiens
tgttttatttattat

SEQ ID NO: 477300 - DNA, 15 bp, Homo sapiens
gttttatttattatg

SEQ ID NO: 477301 - DNA, 15 bp, Homo sapiens
ttttatttattatgg

SEQ ID NO: 477302 - DNA, 15 bp, Homo sapiens
tttatttattatggt

SEQ ID NO: 477303 - DNA, 15 bp, Homo sapiens
ttatttattatggtt

SEQ ID NO: 477304 - DNA, 15 bp, Homo sapiens
tatttattatggtta

SEQ ID NO: 477305 - DNA, 15 bp, Homo sapiens
atttattatggttat

SEQ ID NO: 477306 - DNA, 15 bp, Homo sapiens
tttattatggttata

SEQ ID NO: 477307 - DNA, 15 bp, Homo sapiens
ttattatggttataa

SEQ ID NO: 477308 - DNA, 15 bp, Homo sapiens
tattatggttataaa

SEQ ID NO: 477309 - DNA, 15 bp, Homo sapiens
attatggttataaat

SEQ ID NO: 477310 - DNA, 15 bp, Homo sapiens
ttatggttataaata

SEQ ID NO: 477311 - DNA, 15 bp, Homo sapiens
tatggttataaataa

SEQ ID NO: 477312 - DNA, 15 bp, Homo sapiens
atggttataaataaa

SEQ ID NO: 477313 - DNA, 15 bp, Homo sapiens
tggttataaataaaa

SEQ ID NO: 477314 - DNA, 15 bp, Homo sapiens
ggttataaataaaag

SEQ ID NO: 477315 - DNA, 15 bp, Homo sapiens
gttataaataaaagt

SEQ ID NO: 477316 - DNA, 15 bp, Homo sapiens
ttataaataaaagtt

SEQ ID NO: 477317 - DNA, 15 bp, Homo sapiens
tataaataaaagtta

SEQ ID NO: 477318 - DNA, 15 bp, Homo sapiens
ataaataaaagttat

SEQ ID NO: 477319 - DNA, 15 bp, Homo sapiens
taaataaaagttatc

SEQ ID NO: 477320 - DNA, 15 bp, Homo sapiens
aaataaaagttatca

SEQ ID NO: 477321 - DNA, 15 bp, Homo sapiens
aataaaagttatcag

SEQ ID NO: 477322 - DNA, 15 bp, Homo sapiens
ataaaagttatcagg

SEQ ID NO: 477323 - DNA, 15 bp, Homo sapiens
taaaagttatcagga

SEQ ID NO: 477324 - DNA, 15 bp, Homo sapiens
aaaagttatcaggag

SEQ ID NO: 477325 - DNA, 15 bp, Homo sapiens
aaagttatcaggagg

SEQ ID NO: 477326 - DNA, 15 bp, Homo sapiens
aagttatcaggaggt

SEQ ID NO: 477327 - DNA, 15 bp, Homo sapiens
agttatcaggaggtt

SEQ ID NO: 477328 - DNA, 15 bp, Homo sapiens
gttatcaggaggttt

SEQ ID NO: 477329 - DNA, 15 bp, Homo sapiens
ttatcaggaggtttt

SEQ ID NO: 477330 - DNA, 15 bp, Homo sapiens
tatcaggaggttttt

SEQ ID NO: 477331 - DNA, 15 bp, Homo sapiens
atcaggaggtttttc

SEQ ID NO: 477332 - DNA, 15 bp, Homo sapiens
tcaggaggtttttca

SEQ ID NO: 477333 - DNA, 15 bp, Homo sapiens
caggaggtttttcaa

SEQ ID NO: 477334 - DNA, 15 bp, Homo sapiens
aggaggtttttcaat

SEQ ID NO: 477335 - DNA, 15 bp, Homo sapiens
ggaggtttttcaatt

SEQ ID NO: 477336 - DNA, 15 bp, Homo sapiens
gaggtttttcaattt

SEQ ID NO: 477337 - DNA, 15 bp, Homo sapiens
aggtttttcaatttc

SEQ ID NO: 477338 - DNA, 15 bp, Homo sapiens
ggtttttcaatttca

SEQ ID NO: 477339 - DNA, 15 bp, Homo sapiens
gtttttcaatttcaa

SEQ ID NO: 477340 - DNA, 15 bp, Homo sapiens
tttttcaatttcaaa

SEQ ID NO: 477341 - DNA, 15 bp, Homo sapiens
ttttcaatttcaaat

SEQ ID NO: 477342 - DNA, 15 bp, Homo sapiens
tttcaatttcaaatt

SEQ ID NO: 477343 - DNA, 15 bp, Homo sapiens
ttcaatttcaaattt

SEQ ID NO: 477344 - DNA, 15 bp, Homo sapiens
tcaatttcaaatttc

SEQ ID NO: 477345 - DNA, 15 bp, Homo sapiens
caatttcaaatttca

SEQ ID NO: 477346 - DNA, 15 bp, Homo sapiens
aatttcaaatttcaa

SEQ ID NO: 477347 - DNA, 15 bp, Homo sapiens
atttcaaatttcaaa

SEQ ID NO: 477348 - DNA, 15 bp, Homo sapiens
tttcaaatttcaaag

SEQ ID NO: 477349 - DNA, 15 bp, Homo sapiens
ttcaaatttcaaaga

SEQ ID NO: 477350 - DNA, 15 bp, Homo sapiens
tcaaatttcaaagat

SEQ ID NO: 477351 - DNA, 15 bp, Homo sapiens
caaatttcaaagatt

SEQ ID NO: 477352 - DNA, 15 bp, Homo sapiens
aaatttcaaagattg

SEQ ID NO: 477353 - DNA, 15 bp, Homo sapiens
aatttcaaagattgc

SEQ ID NO: 477354 - DNA, 15 bp, Homo sapiens
atttcaaagattgca

SEQ ID NO: 477355 - DNA, 15 bp, Homo sapiens
tttcaaagattgcat

SEQ ID NO: 477356 - DNA, 15 bp, Homo sapiens
ttcaaagattgcatc

SEQ ID NO: 477357 - DNA, 15 bp, Homo sapiens
tcaaagattgcatct

SEQ ID NO: 477358 - DNA, 15 bp, Homo sapiens
caaagattgcatctt

SEQ ID NO: 477359 - DNA, 15 bp, Homo sapiens
aaagattgcatctta

SEQ ID NO: 477360 - DNA, 15 bp, Homo sapiens
aagattgcatcttaa

SEQ ID NO: 477361 - DNA, 15 bp, Homo sapiens
agattgcatcttaat

SEQ ID NO: 477362 - DNA, 15 bp, Homo sapiens
gattgcatcttaata

SEQ ID NO: 477363 - DNA, 15 bp, Homo sapiens
attgcatcttaatac

SEQ ID NO: 477364 - DNA, 15 bp, Homo sapiens
ttgcatcttaatact

SEQ ID NO: 477365 - DNA, 15 bp, Homo sapiens
tgcatcttaatactt

SEQ ID NO: 477366 - DNA, 15 bp, Homo sapiens
gcatcttaatacttg

SEQ ID NO: 477367 - DNA, 15 bp, Homo sapiens
catcttaatacttga

SEQ ID NO: 477368 - DNA, 15 bp, Homo sapiens
atcttaatacttgac

SEQ ID NO: 477369 - DNA, 15 bp, Homo sapiens
tcttaatacttgaca

SEQ ID NO: 477370 - DNA, 15 bp, Homo sapiens
cttaatacttgacag

SEQ ID NO: 477371 - DNA, 15 bp, Homo sapiens
ttaatacttgacagt

SEQ ID NO: 477372 - DNA, 15 bp, Homo sapiens
taatacttgacagta

SEQ ID NO: 477373 - DNA, 15 bp, Homo sapiens
aatacttgacagtaa

SEQ ID NO: 477374 - DNA, 15 bp, Homo sapiens
atacttgacagtaat

SEQ ID NO: 477375 - DNA, 15 bp, Homo sapiens
tacttgacagtaatg

SEQ ID NO: 477376 - DNA, 15 bp, Homo sapiens
acttgacagtaatgt

SEQ ID NO: 477377 - DNA, 15 bp, Homo sapiens
cttgacagtaatgta

SEQ ID NO: 477378 - DNA, 15 bp, Homo sapiens
ttgacagtaatgtag

SEQ ID NO: 477379 - DNA, 15 bp, Homo sapiens
tgacagtaatgtagt

SEQ ID NO: 477380 - DNA, 15 bp, Homo sapiens
gacagtaatgtagta

SEQ ID NO: 477381 - DNA, 15 bp, Homo sapiens
acagtaatgtagtag

SEQ ID NO: 477382 - DNA, 15 bp, Homo sapiens
cagtaatgtagtaga

SEQ ID NO: 477383 - DNA, 15 bp, Homo sapiens
agtaatgtagtagag

SEQ ID NO: 477384 - DNA, 15 bp, Homo sapiens
gtaatgtagtagaga

SEQ ID NO: 477385 - DNA, 15 bp, Homo sapiens
taatgtagtagagat

SEQ ID NO: 477386 - DNA, 15 bp, Homo sapiens
aatgtagtagagatt

SEQ ID NO: 477387 - DNA, 15 bp, Homo sapiens
atgtagtagagattt

SEQ ID NO: 477388 - DNA, 15 bp, Homo sapiens
tgtagtagagattta

SEQ ID NO: 477389 - DNA, 15 bp, Homo sapiens
gtagtagagatttat

SEQ ID NO: 477390 - DNA, 15 bp, Homo sapiens
tagtagagatttata

SEQ ID NO: 477391 - DNA, 15 bp, Homo sapiens
agtagagatttatac

SEQ ID NO: 477392 - DNA, 15 bp, Homo sapiens
gtagagatttataca

SEQ ID NO: 477393 - DNA, 15 bp, Homo sapiens
tagagatttatacat

SEQ ID NO: 477394 - DNA, 15 bp, Homo sapiens
agagatttatacatt

SEQ ID NO: 477395 - DNA, 15 bp, Homo sapiens
gagatttatacatta

SEQ ID NO: 477396 - DNA, 15 bp, Homo sapiens
agatttatacattat

SEQ ID NO: 477397 - DNA, 15 bp, Homo sapiens
gatttatacattatc

SEQ ID NO: 477398 - DNA, 15 bp, Homo sapiens
atttatacattatca

SEQ ID NO: 477399 - DNA, 15 bp, Homo sapiens
tttatacattatcat

SEQ ID NO: 477400 - DNA, 15 bp, Homo sapiens
ttatacattatcatt

SEQ ID NO: 477401 - DNA, 15 bp, Homo sapiens
tatacattatcattc

SEQ ID NO: 477402 - DNA, 15 bp, Homo sapiens
atacattatcattca

SEQ ID NO: 477403 - DNA, 15 bp, Homo sapiens
tacattatcattcat

SEQ ID NO: 477404 - DNA, 15 bp, Homo sapiens
acattatcattcatg

SEQ ID NO: 477405 - DNA, 15 bp, Homo sapiens
cattatcattcatgt

SEQ ID NO: 477406 - DNA, 15 bp, Homo sapiens
attatcattcatgta

SEQ ID NO: 477407 - DNA, 15 bp, Homo sapiens
ttatcattcatgtac

SEQ ID NO: 477408 - DNA, 15 bp, Homo sapiens
tatcattcatgtact

SEQ ID NO: 477409 - DNA, 15 bp, Homo sapiens
atcattcatgtacta

SEQ ID NO: 477410 - DNA, 15 bp, Homo sapiens
tcattcatgtactat

SEQ ID NO: 477411 - DNA, 15 bp, Homo sapiens
cattcatgtactatg

SEQ ID NO: 477412 - DNA, 15 bp, Homo sapiens
attcatgtactatga

SEQ ID NO: 477413 - DNA, 15 bp, Homo sapiens
ttcatgtactatgag

SEQ ID NO: 477414 - DNA, 15 bp, Homo sapiens
tcatgtactatgagt

SEQ ID NO: 477415 - DNA, 15 bp, Homo sapiens
catgtactatgagtg

SEQ ID NO: 477416 - DNA, 15 bp, Homo sapiens
atgtactatgagtgt

SEQ ID NO: 477417 - DNA, 15 bp, Homo sapiens
tgtactatgagtgtg

SEQ ID NO: 477418 - DNA, 15 bp, Homo sapiens
gtactatgagtgtga

SEQ ID NO: 477419 - DNA, 15 bp, Homo sapiens
tactatgagtgtgaa

SEQ ID NO: 477420 - DNA, 15 bp, Homo sapiens
actatgagtgtgaaa

SEQ ID NO: 477421 - DNA, 15 bp, Homo sapiens
ctatgagtgtgaaac

SEQ ID NO: 477422 - DNA, 15 bp, Homo sapiens
tatgagtgtgaaaca

SEQ ID NO: 477423 - DNA, 15 bp, Homo sapiens
atgagtgtgaaacaa

SEQ ID NO: 477424 - DNA, 15 bp, Homo sapiens
tgagtgtgaaacaat

SEQ ID NO: 477425 - DNA, 15 bp, Homo sapiens
gagtgtgaaacaatt

SEQ ID NO: 477426 - DNA, 15 bp, Homo sapiens
agtgtgaaacaattc

SEQ ID NO: 477427 - DNA, 15 bp, Homo sapiens
gtgtgaaacaattcc

SEQ ID NO: 477428 - DNA, 15 bp, Homo sapiens
tgtgaaacaattccc

SEQ ID NO: 477429 - DNA, 15 bp, Homo sapiens
gtgaaacaattccca

SEQ ID NO: 477430 - DNA, 15 bp, Homo sapiens
tgaaacaattcccaa

SEQ ID NO: 477431 - DNA, 15 bp, Homo sapiens
gaaacaattcccaaa

SEQ ID NO: 477432 - DNA, 15 bp, Homo sapiens
aaacaattcccaaat

SEQ ID NO: 477433 - DNA, 15 bp, Homo sapiens
aacaattcccaaatc

SEQ ID NO: 477434 - DNA, 15 bp, Homo sapiens
acaattcccaaatca

SEQ ID NO: 477435 - DNA, 15 bp, Homo sapiens
caattcccaaatcaa

SEQ ID NO: 477436 - DNA, 15 bp, Homo sapiens
aattcccaaatcaaa

SEQ ID NO: 477437 - DNA, 15 bp, Homo sapiens
attcccaaatcaaaa

SEQ ID NO: 477438 - DNA, 15 bp, Homo sapiens
ttcccaaatcaaaat

SEQ ID NO: 477439 - DNA, 15 bp, Homo sapiens
tcccaaatcaaaata

SEQ ID NO: 477440 - DNA, 15 bp, Homo sapiens
cccaaatcaaaataa

SEQ ID NO: 477441 - DNA, 15 bp, Homo sapiens
ccaaatcaaaataaa

SEQ ID NO: 477442 - DNA, 15 bp, Homo sapiens
caaatcaaaataaag

SEQ ID NO: 477443 - DNA, 15 bp, Homo sapiens
aaatcaaaataaagg

SEQ ID NO: 477444 - DNA, 15 bp, Homo sapiens
aatcaaaataaaggt

SEQ ID NO: 477445 - DNA, 15 bp, Homo sapiens
atcaaaataaaggtg

SEQ ID NO: 477446 - DNA, 15 bp, Homo sapiens
tcaaaataaaggtgt

SEQ ID NO: 477447 - DNA, 15 bp, Homo sapiens
caaaataaaggtgta

SEQ ID NO: 477448 - DNA, 15 bp, Homo sapiens
aaaataaaggtgtat

SEQ ID NO: 477449 - DNA, 15 bp, Homo sapiens
aaataaaggtgtatt

SEQ ID NO: 477450 - DNA, 15 bp, Homo sapiens
aataaaggtgtattc

SEQ ID NO: 477451 - DNA, 15 bp, Homo sapiens
ataaaggtgtattca

SEQ ID NO: 477452 - DNA, 15 bp, Homo sapiens
taaaggtgtattcat

SEQ ID NO: 477453 - DNA, 15 bp, Homo sapiens
aaaggtgtattcata

SEQ ID NO: 477454 - DNA, 15 bp, Homo sapiens
aaggtgtattcataa

SEQ ID NO: 477455 - DNA, 15 bp, Homo sapiens
aggtgtattcataat

SEQ ID NO: 477456 - DNA, 15 bp, Homo sapiens
ggtgtattcataatg

SEQ ID NO: 477457 - DNA, 15 bp, Homo sapiens
gtgtattcataatgt

SEQ ID NO: 477458 - DNA, 15 bp, Homo sapiens
tgtattcataatgtt

SEQ ID NO: 477459 - DNA, 15 bp, Homo sapiens
gtattcataatgttt

SEQ ID NO: 477460 - DNA, 15 bp, Homo sapiens
tattcataatgtttg

SEQ ID NO: 477461 - DNA, 15 bp, Homo sapiens
attcataatgtttgt

SEQ ID NO: 477462 - DNA, 15 bp, Homo sapiens
ttcataatgtttgtt

SEQ ID NO: 477463 - DNA, 15 bp, Homo sapiens
tcataatgtttgttt

SEQ ID NO: 477464 - DNA, 15 bp, Homo sapiens
cataatgtttgtttc

SEQ ID NO: 477465 - DNA, 15 bp, Homo sapiens
ataatgtttgtttca

SEQ ID NO: 477466 - DNA, 15 bp, Homo sapiens
taatgtttgtttcat

SEQ ID NO: 477467 - DNA, 15 bp, Homo sapiens
aatgtttgtttcata

SEQ ID NO: 477468 - DNA, 15 bp, Homo sapiens
atgtttgtttcatat

SEQ ID NO: 477469 - DNA, 15 bp, Homo sapiens
tgtttgtttcatatt

SEQ ID NO: 477470 - DNA, 15 bp, Homo sapiens
gtttgtttcatattt

SEQ ID NO: 477471 - DNA, 15 bp, Homo sapiens
tttgtttcatattta

SEQ ID NO: 477472 - DNA, 15 bp, Homo sapiens
ttgtttcatatttaa

SEQ ID NO: 477473 - DNA, 15 bp, Homo sapiens
tgtttcatatttaac

SEQ ID NO: 477474 - DNA, 15 bp, Homo sapiens
gtttcatatttaacc

SEQ ID NO: 477475 - DNA, 15 bp, Homo sapiens
tttcatatttaacct

SEQ ID NO: 477476 - DNA, 15 bp, Homo sapiens
ttcatatttaaccta

SEQ ID NO: 477477 - DNA, 15 bp, Homo sapiens
tcatatttaacctac

SEQ ID NO: 477478 - DNA, 15 bp, Homo sapiens
catatttaacctact

SEQ ID NO: 477479 - DNA, 15 bp, Homo sapiens
atatttaacctactg

SEQ ID NO: 477480 - DNA, 15 bp, Homo sapiens
tatttaacctactgg

SEQ ID NO: 477481 - DNA, 15 bp, Homo sapiens
atttaacctactggt

SEQ ID NO: 477482 - DNA, 15 bp, Homo sapiens
tttaacctactggtg

SEQ ID NO: 477483 - DNA, 15 bp, Homo sapiens
ttaacctactggtgt

SEQ ID NO: 477484 - DNA, 15 bp, Homo sapiens
taacctactggtgtg

SEQ ID NO: 477485 - DNA, 15 bp, Homo sapiens
aacctactggtgtgc

SEQ ID NO: 477486 - DNA, 15 bp, Homo sapiens
acctactggtgtgca

SEQ ID NO: 477487 - DNA, 15 bp, Homo sapiens
cctactggtgtgcat

SEQ ID NO: 477488 - DNA, 15 bp, Homo sapiens
ctactggtgtgcatt

SEQ ID NO: 477489 - DNA, 15 bp, Homo sapiens
tactggtgtgcattt

SEQ ID NO: 477490 - DNA, 15 bp, Homo sapiens
actggtgtgcatttc

SEQ ID NO: 477491 - DNA, 15 bp, Homo sapiens
ctggtgtgcatttca

SEQ ID NO: 477492 - DNA, 15 bp, Homo sapiens
tggtgtgcatttcat

SEQ ID NO: 477493 - DNA, 15 bp, Homo sapiens
ggtgtgcatttcatg

SEQ ID NO: 477494 - DNA, 15 bp, Homo sapiens
gtgtgcatttcatgt

SEQ ID NO: 477495 - DNA, 15 bp, Homo sapiens
tgtgcatttcatgta

SEQ ID NO: 477496 - DNA, 15 bp, Homo sapiens
gtgcatttcatgtaa

SEQ ID NO: 477497 - DNA, 15 bp, Homo sapiens
tgcatttcatgtaaa

SEQ ID NO: 477498 - DNA, 15 bp, Homo sapiens
gcatttcatgtaaag

SEQ ID NO: 477499 - DNA, 15 bp, Homo sapiens
catttcatgtaaagt

SEQ ID NO: 477500 - DNA, 15 bp, Homo sapiens
atttcatgtaaagta

SEQ ID NO: 477501 - DNA, 15 bp, Homo sapiens
tttcatgtaaagtag

SEQ ID NO: 477502 - DNA, 15 bp, Homo sapiens
ttcatgtaaagtagt

SEQ ID NO: 477503 - DNA, 15 bp, Homo sapiens
tcatgtaaagtagtt

SEQ ID NO: 477504 - DNA, 15 bp, Homo sapiens
catgtaaagtagtta

SEQ ID NO: 477505 - DNA, 15 bp, Homo sapiens
atgtaaagtagttaa

SEQ ID NO: 477506 - DNA, 15 bp, Homo sapiens
tgtaaagtagttaag

SEQ ID NO: 477507 - DNA, 15 bp, Homo sapiens
gtaaagtagttaagt

SEQ ID NO: 477508 - DNA, 15 bp, Homo sapiens
taaagtagttaagta

SEQ ID NO: 477509 - DNA, 15 bp, Homo sapiens
aaagtagttaagtat

SEQ ID NO: 477510 - DNA, 15 bp, Homo sapiens
aagtagttaagtatc

SEQ ID NO: 477511 - DNA, 15 bp, Homo sapiens
agtagttaagtatct

SEQ ID NO: 477512 - DNA, 15 bp, Homo sapiens
gtagttaagtatctt

SEQ ID NO: 477513 - DNA, 15 bp, Homo sapiens
tagttaagtatcttg

SEQ ID NO: 477514 - DNA, 15 bp, Homo sapiens
agttaagtatcttga

SEQ ID NO: 477515 - DNA, 15 bp, Homo sapiens
gttaagtatcttgaa

SEQ ID NO: 477516 - DNA, 15 bp, Homo sapiens
ttaagtatcttgaat

SEQ ID NO: 477517 - DNA, 15 bp, Homo sapiens
taagtatcttgaatc

SEQ ID NO: 477518 - DNA, 15 bp, Homo sapiens
aagtatcttgaatct

SEQ ID NO: 477519 - DNA, 15 bp, Homo sapiens
agtatcttgaatctt

SEQ ID NO: 477520 - DNA, 15 bp, Homo sapiens
gtatcttgaatcttt

SEQ ID NO: 477521 - DNA, 15 bp, Homo sapiens
tatcttgaatctttc

SEQ ID NO: 477522 - DNA, 15 bp, Homo sapiens
atcttgaatctttcc

SEQ ID NO: 477523 - DNA, 15 bp, Homo sapiens
tcttgaatctttcct

SEQ ID NO: 477524 - DNA, 15 bp, Homo sapiens
cttgaatctttccta

SEQ ID NO: 477525 - DNA, 15 bp, Homo sapiens
ttgaatctttcctaa

SEQ ID NO: 477526 - DNA, 15 bp, Homo sapiens
tgaatctttcctaaa

SEQ ID NO: 477527 - DNA, 15 bp, Homo sapiens
gaatctttcctaaat

SEQ ID NO: 477528 - DNA, 15 bp, Homo sapiens
aatctttcctaaatc

SEQ ID NO: 477529 - DNA, 15 bp, Homo sapiens
atctttcctaaatca

SEQ ID NO: 477530 - DNA, 15 bp, Homo sapiens
tctttcctaaatcaa

SEQ ID NO: 477531 - DNA, 15 bp, Homo sapiens
ctttcctaaatcaac

SEQ ID NO: 477532 - DNA, 15 bp, Homo sapiens
tttcctaaatcaaca

SEQ ID NO: 477533 - DNA, 15 bp, Homo sapiens
ttcctaaatcaacaa

SEQ ID NO: 477534 - DNA, 15 bp, Homo sapiens
tcctaaatcaacaaa

SEQ ID NO: 477535 - DNA, 15 bp, Homo sapiens
cctaaatcaacaaat

SEQ ID NO: 477536 - DNA, 15 bp, Homo sapiens
ctaaatcaacaaatt

SEQ ID NO: 477537 - DNA, 15 bp, Homo sapiens
taaatcaacaaattt

SEQ ID NO: 477538 - DNA, 15 bp, Homo sapiens
aaatcaacaaatttc

SEQ ID NO: 477539 - DNA, 15 bp, Homo sapiens
aatcaacaaatttcc

SEQ ID NO: 477540 - DNA, 15 bp, Homo sapiens
atcaacaaatttcct

SEQ ID NO: 477541 - DNA, 15 bp, Homo sapiens
tcaacaaatttcctc

SEQ ID NO: 477542 - DNA, 15 bp, Homo sapiens
caacaaatttcctca

SEQ ID NO: 477543 - DNA, 15 bp, Homo sapiens
aacaaatttcctcaa

SEQ ID NO: 477544 - DNA, 15 bp, Homo sapiens
acaaatttcctcaag

SEQ ID NO: 477545 - DNA, 15 bp, Homo sapiens
caaatttcctcaagg

SEQ ID NO: 477546 - DNA, 15 bp, Homo sapiens
aaatttcctcaaggc

SEQ ID NO: 477547 - DNA, 15 bp, Homo sapiens
aatttcctcaaggct

SEQ ID NO: 477548 - DNA, 15 bp, Homo sapiens
atttcctcaaggctg

SEQ ID NO: 477549 - DNA, 15 bp, Homo sapiens
tttcctcaaggctga

SEQ ID NO: 477550 - DNA, 15 bp, Homo sapiens
ttcctcaaggctgac

SEQ ID NO: 477551 - DNA, 15 bp, Homo sapiens
tcctcaaggctgacc

SEQ ID NO: 477552 - DNA, 15 bp, Homo sapiens
cctcaaggctgacca

SEQ ID NO: 477553 - DNA, 15 bp, Homo sapiens
ctcaaggctgaccat

SEQ ID NO: 477554 - DNA, 15 bp, Homo sapiens
tcaaggctgaccata

SEQ ID NO: 477555 - DNA, 15 bp, Homo sapiens
caaggctgaccatag

SEQ ID NO: 477556 - DNA, 15 bp, Homo sapiens
aaggctgaccatagc

SEQ ID NO: 477557 - DNA, 15 bp, Homo sapiens
aggctgaccatagcc

SEQ ID NO: 477558 - DNA, 15 bp, Homo sapiens
ggctgaccatagcca

SEQ ID NO: 477559 - DNA, 15 bp, Homo sapiens
gctgaccatagccaa

SEQ ID NO: 477560 - DNA, 15 bp, Homo sapiens
ctgaccatagccaaa

SEQ ID NO: 477561 - DNA, 15 bp, Homo sapiens
tgaccatagccaaag

SEQ ID NO: 477562 - DNA, 15 bp, Homo sapiens
gaccatagccaaagc

SEQ ID NO: 477563 - DNA, 15 bp, Homo sapiens
accatagccaaagcg

SEQ ID NO: 477564 - DNA, 15 bp, Homo sapiens
ccatagccaaagcgt

SEQ ID NO: 477565 - DNA, 15 bp, Homo sapiens
catagccaaagcgtt

SEQ ID NO: 477566 - DNA, 15 bp, Homo sapiens
atagccaaagcgtta

SEQ ID NO: 477567 - DNA, 15 bp, Homo sapiens
tagccaaagcgttaa

SEQ ID NO: 477568 - DNA, 15 bp, Homo sapiens
agccaaagcgttaaa

SEQ ID NO: 477569 - DNA, 15 bp, Homo sapiens
gccaaagcgttaaag

SEQ ID NO: 477570 - DNA, 15 bp, Homo sapiens
ccaaagcgttaaagg

SEQ ID NO: 477571 - DNA, 15 bp, Homo sapiens
caaagcgttaaagga

SEQ ID NO: 477572 - DNA, 15 bp, Homo sapiens
aaagcgttaaaggaa

SEQ ID NO: 477573 - DNA, 15 bp, Homo sapiens
aagcgttaaaggaaa

SEQ ID NO: 477574 - DNA, 15 bp, Homo sapiens
agcgttaaaggaaat

SEQ ID NO: 477575 - DNA, 15 bp, Homo sapiens
gcgttaaaggaaata

SEQ ID NO: 477576 - DNA, 15 bp, Homo sapiens
cgttaaaggaaataa

SEQ ID NO: 477577 - DNA, 15 bp, Homo sapiens
gttaaaggaaataaa

SEQ ID NO: 477578 - DNA, 15 bp, Homo sapiens
ttaaaggaaataaaa

SEQ ID NO: 477579 - DNA, 15 bp, Homo sapiens
taaaggaaataaaag

SEQ ID NO: 477580 - DNA, 15 bp, Homo sapiens
aaaggaaataaaaga

SEQ ID NO: 477581 - DNA, 15 bp, Homo sapiens
aaggaaataaaagat

SEQ ID NO: 477582 - DNA, 15 bp, Homo sapiens
aggaaataaaagata

SEQ ID NO: 477583 - DNA, 15 bp, Homo sapiens
ggaaataaaagataa

SEQ ID NO: 477584 - DNA, 15 bp, Homo sapiens
gaaataaaagataat

SEQ ID NO: 477585 - DNA, 15 bp, Homo sapiens
aaataaaagataata

SEQ ID NO: 477586 - DNA, 15 bp, Homo sapiens
aataaaagataataa

SEQ ID NO: 477587 - DNA, 15 bp, Homo sapiens
aaaagataataattc

SEQ ID NO: 477588 - DNA, 15 bp, Homo sapiens
aaagataataattca

SEQ ID NO: 477589 - DNA, 15 bp, Homo sapiens
aagataataattcag

SEQ ID NO: 477590 - DNA, 15 bp, Homo sapiens
agataataattcaga

SEQ ID NO: 477591 - DNA, 15 bp, Homo sapiens
gataataattcagaa

SEQ ID NO: 477592 - DNA, 15 bp, Homo sapiens
ataataattcagaac

SEQ ID NO: 477593 - DNA, 15 bp, Homo sapiens
taataattcagaaca

SEQ ID NO: 477594 - DNA, 15 bp, Homo sapiens
aattcagaacaaaat

SEQ ID NO: 477595 - DNA, 15 bp, Homo sapiens
attcagaacaaaatc

SEQ ID NO: 477596 - DNA, 15 bp, Homo sapiens
ttcagaacaaaatct

SEQ ID NO: 477597 - DNA, 15 bp, Homo sapiens
tcagaacaaaatctt

SEQ ID NO: 477598 - DNA, 15 bp, Homo sapiens
cagaacaaaatctta

SEQ ID NO: 477599 - DNA, 15 bp, Homo sapiens
agaacaaaatcttac

SEQ ID NO: 477600 - DNA, 15 bp, Homo sapiens
gaacaaaatcttact

SEQ ID NO: 477601 - DNA, 15 bp, Homo sapiens
aacaaaatcttactt

SEQ ID NO: 477602 - DNA, 15 bp, Homo sapiens
acaaaatcttacttc

SEQ ID NO: 477603 - DNA, 15 bp, Homo sapiens
caaaatcttacttct

SEQ ID NO: 477604 - DNA, 15 bp, Homo sapiens
aaaatcttacttctt

SEQ ID NO: 477605 - DNA, 15 bp, Homo sapiens
aaatcttacttcttt

SEQ ID NO: 477606 - DNA, 15 bp, Homo sapiens
aatcttacttcttta

SEQ ID NO: 477607 - DNA, 15 bp, Homo sapiens
atcttacttctttaa

SEQ ID NO: 477608 - DNA, 15 bp, Homo sapiens
tcttacttctttaaa

SEQ ID NO: 477609 - DNA, 15 bp, Homo sapiens
cttacttctttaaaa

SEQ ID NO: 477610 - DNA, 15 bp, Homo sapiens
ttacttctttaaaat

SEQ ID NO: 477611 - DNA, 15 bp, Homo sapiens
tacttctttaaaatg

SEQ ID NO: 477612 - DNA, 15 bp, Homo sapiens
acttctttaaaatgt

SEQ ID NO: 477613 - DNA, 15 bp, Homo sapiens
cttctttaaaatgtt

SEQ ID NO: 477614 - DNA, 15 bp, Homo sapiens
ttctttaaaatgttt

SEQ ID NO: 477615 - DNA, 15 bp, Homo sapiens
tctttaaaatgtttt

SEQ ID NO: 477616 - DNA, 15 bp, Homo sapiens
ctttaaaatgttttg

SEQ ID NO: 477617 - DNA, 15 bp, Homo sapiens
tttaaaatgttttgt

SEQ ID NO: 477618 - DNA, 15 bp, Homo sapiens
ttaaaatgttttgtc

SEQ ID NO: 477619 - DNA, 15 bp, Homo sapiens
taaaatgttttgtca

SEQ ID NO: 477620 - DNA, 15 bp, Homo sapiens
aaaatgttttgtcat

SEQ ID NO: 477621 - DNA, 15 bp, Homo sapiens
aaatgttttgtcatg

SEQ ID NO: 477622 - DNA, 15 bp, Homo sapiens
aatgttttgtcatgc

SEQ ID NO: 477623 - DNA, 15 bp, Homo sapiens
atgttttgtcatgcc

SEQ ID NO: 477624 - DNA, 15 bp, Homo sapiens
tgttttgtcatgccc

SEQ ID NO: 477625 - DNA, 15 bp, Homo sapiens
gttttgtcatgccct

SEQ ID NO: 477626 - DNA, 15 bp, Homo sapiens
ttttgtcatgccctg

SEQ ID NO: 477627 - DNA, 15 bp, Homo sapiens
tttgtcatgccctgt

SEQ ID NO: 477628 - DNA, 15 bp, Homo sapiens
ttgtcatgccctgtg

SEQ ID NO: 477629 - DNA, 15 bp, Homo sapiens
tgtcatgccctgtga

SEQ ID NO: 477630 - DNA, 15 bp, Homo sapiens
gtcatgccctgtgaa

SEQ ID NO: 477631 - DNA, 15 bp, Homo sapiens
tcatgccctgtgaac

SEQ ID NO: 477632 - DNA, 15 bp, Homo sapiens
catgccctgtgaaca

SEQ ID NO: 477633 - DNA, 15 bp, Homo sapiens
atgccctgtgaacac

SEQ ID NO: 477634 - DNA, 15 bp, Homo sapiens
tgccctgtgaacaca

SEQ ID NO: 477635 - DNA, 15 bp, Homo sapiens
gccctgtgaacacag

SEQ ID NO: 477636 - DNA, 15 bp, Homo sapiens
ccctgtgaacacagt

SEQ ID NO: 477637 - DNA, 15 bp, Homo sapiens
cctgtgaacacagta

SEQ ID NO: 477638 - DNA, 15 bp, Homo sapiens
ctgtgaacacagtaa

SEQ ID NO: 477639 - DNA, 15 bp, Homo sapiens
tgtgaacacagtaaa

SEQ ID NO: 477640 - DNA, 15 bp, Homo sapiens
gtgaacacagtaaag

SEQ ID NO: 477641 - DNA, 15 bp, Homo sapiens
tgaacacagtaaagg

SEQ ID NO: 477642 - DNA, 15 bp, Homo sapiens
gaacacagtaaaggt

SEQ ID NO: 477643 - DNA, 15 bp, Homo sapiens
aacacagtaaaggta

SEQ ID NO: 477644 - DNA, 15 bp, Homo sapiens
acacagtaaaggtaa

SEQ ID NO: 477645 - DNA, 15 bp, Homo sapiens
cacagtaaaggtaat

SEQ ID NO: 477646 - DNA, 15 bp, Homo sapiens
acagtaaaggtaatg

SEQ ID NO: 477647 - DNA, 15 bp, Homo sapiens
cagtaaaggtaatgc

SEQ ID NO: 477648 - DNA, 15 bp, Homo sapiens
agtaaaggtaatgct

SEQ ID NO: 477649 - DNA, 15 bp, Homo sapiens
gtaaaggtaatgctc

SEQ ID NO: 477650 - DNA, 15 bp, Homo sapiens
taaaggtaatgctca

SEQ ID NO: 477651 - DNA, 15 bp, Homo sapiens
aaaggtaatgctcaa

SEQ ID NO: 477652 - DNA, 15 bp, Homo sapiens
aaggtaatgctcaaa

SEQ ID NO: 477653 - DNA, 15 bp, Homo sapiens
aggtaatgctcaaat

SEQ ID NO: 477654 - DNA, 15 bp, Homo sapiens
ggtaatgctcaaatt

SEQ ID NO: 477655 - DNA, 15 bp, Homo sapiens
gtaatgctcaaattt

SEQ ID NO: 477656 - DNA, 15 bp, Homo sapiens
taatgctcaaattta

SEQ ID NO: 477657 - DNA, 15 bp, Homo sapiens
aatgctcaaatttag

SEQ ID NO: 477658 - DNA, 15 bp, Homo sapiens
atgctcaaatttagt

SEQ ID NO: 477659 - DNA, 15 bp, Homo sapiens
tgctcaaatttagta

SEQ ID NO: 477660 - DNA, 15 bp, Homo sapiens
gctcaaatttagtat

SEQ ID NO: 477661 - DNA, 15 bp, Homo sapiens
ctcaaatttagtata

SEQ ID NO: 477662 - DNA, 15 bp, Homo sapiens
tcaaatttagtatat

SEQ ID NO: 477663 - DNA, 15 bp, Homo sapiens
caaatttagtatatt

SEQ ID NO: 477664 - DNA, 15 bp, Homo sapiens
aaatttagtatattg

SEQ ID NO: 477665 - DNA, 15 bp, Homo sapiens
aatttagtatattgt

SEQ ID NO: 477666 - DNA, 15 bp, Homo sapiens
atttagtatattgta

SEQ ID NO: 477667 - DNA, 15 bp, Homo sapiens
tttagtatattgtat

SEQ ID NO: 477668 - DNA, 15 bp, Homo sapiens
ttagtatattgtatc

SEQ ID NO: 477669 - DNA, 15 bp, Homo sapiens
tagtatattgtatct

SEQ ID NO: 477670 - DNA, 15 bp, Homo sapiens
agtatattgtatctt

SEQ ID NO: 477671 - DNA, 15 bp, Homo sapiens
gtatattgtatctta

SEQ ID NO: 477672 - DNA, 15 bp, Homo sapiens
tatattgtatcttaa

SEQ ID NO: 477673 - DNA, 15 bp, Homo sapiens
atattgtatcttaaa

SEQ ID NO: 477674 - DNA, 15 bp, Homo sapiens
tattgtatcttaaaa

SEQ ID NO: 477675 - DNA, 15 bp, Homo sapiens
attgtatcttaaaat

SEQ ID NO: 477676 - DNA, 15 bp, Homo sapiens
ttgtatcttaaaata

SEQ ID NO: 477677 - DNA, 15 bp, Homo sapiens
tgtatcttaaaatag

SEQ ID NO: 477678 - DNA, 15 bp, Homo sapiens
gtatcttaaaatagg

SEQ ID NO: 477679 - DNA, 15 bp, Homo sapiens
tatcttaaaatagga

SEQ ID NO: 477680 - DNA, 15 bp, Homo sapiens
atcttaaaataggaa

SEQ ID NO: 477681 - DNA, 15 bp, Homo sapiens
tcttaaaataggaat

SEQ ID NO: 477682 - DNA, 15 bp, Homo sapiens
cttaaaataggaata

SEQ ID NO: 477683 - DNA, 15 bp, Homo sapiens
ttaaaataggaataa

SEQ ID NO: 477684 - DNA, 15 bp, Homo sapiens
taaaataggaataaa

SEQ ID NO: 477685 - DNA, 15 bp, Homo sapiens
aaaataggaataaat

SEQ ID NO: 477686 - DNA, 15 bp, Homo sapiens
aaataggaataaata

SEQ ID NO: 477687 - DNA, 15 bp, Homo sapiens
aataggaataaatac

SEQ ID NO: 477688 - DNA, 15 bp, Homo sapiens
ataggaataaatact

SEQ ID NO: 477689 - DNA, 15 bp, Homo sapiens
taggaataaatacta

SEQ ID NO: 477690 - DNA, 15 bp, Homo sapiens
aggaataaatactat

SEQ ID NO: 477691 - DNA, 15 bp, Homo sapiens
ggaataaatactatt

SEQ ID NO: 477692 - DNA, 15 bp, Homo sapiens
gaataaatactattt

SEQ ID NO: 477693 - DNA, 15 bp, Homo sapiens
aataaatactatttt

SEQ ID NO: 477694 - DNA, 15 bp, Homo sapiens
ataaatactattttc

SEQ ID NO: 477695 - DNA, 15 bp, Homo sapiens
taaatactattttca

SEQ ID NO: 477696 - DNA, 15 bp, Homo sapiens
aaatactattttcag

SEQ ID NO: 477697 - DNA, 15 bp, Homo sapiens
aatactattttcaga

SEQ ID NO: 477698 - DNA, 15 bp, Homo sapiens
atactattttcagat

SEQ ID NO: 477699 - DNA, 15 bp, Homo sapiens
tactattttcagatt

SEQ ID NO: 477700 - DNA, 15 bp, Homo sapiens
actattttcagattt

SEQ ID NO: 477701 - DNA, 15 bp, Homo sapiens
ctattttcagattta

SEQ ID NO: 477702 - DNA, 15 bp, Homo sapiens
tattttcagatttag

SEQ ID NO: 477703 - DNA, 15 bp, Homo sapiens
attttcagatttagc

SEQ ID NO: 477704 - DNA, 15 bp, Homo sapiens
ttttcagatttagca

SEQ ID NO: 477705 - DNA, 15 bp, Homo sapiens
tttcagatttagcac

SEQ ID NO: 477706 - DNA, 15 bp, Homo sapiens
ttcagatttagcact

SEQ ID NO: 477707 - DNA, 15 bp, Homo sapiens
tcagatttagcactg

SEQ ID NO: 477708 - DNA, 15 bp, Homo sapiens
cagatttagcactgt

SEQ ID NO: 477709 - DNA, 15 bp, Homo sapiens
agatttagcactgtt

SEQ ID NO: 477710 - DNA, 15 bp, Homo sapiens
gatttagcactgttt

SEQ ID NO: 477711 - DNA, 15 bp, Homo sapiens
atttagcactgtttc

SEQ ID NO: 477712 - DNA, 15 bp, Homo sapiens
tttagcactgtttca

SEQ ID NO: 477713 - DNA, 15 bp, Homo sapiens
ttagcactgtttcag

SEQ ID NO: 477714 - DNA, 15 bp, Homo sapiens
tagcactgtttcaga

SEQ ID NO: 477715 - DNA, 15 bp, Homo sapiens
agcactgtttcagaa

SEQ ID NO: 477716 - DNA, 15 bp, Homo sapiens
gcactgtttcagaaa

SEQ ID NO: 477717 - DNA, 15 bp, Homo sapiens
cactgtttcagaaaa

SEQ ID NO: 477718 - DNA, 15 bp, Homo sapiens
actgtttcagaaaag

SEQ ID NO: 477719 - DNA, 15 bp, Homo sapiens
ctgtttcagaaaaga

SEQ ID NO: 477720 - DNA, 15 bp, Homo sapiens
tgtttcagaaaagat

SEQ ID NO: 477721 - DNA, 15 bp, Homo sapiens
gtttcagaaaagatt

SEQ ID NO: 477722 - DNA, 15 bp, Homo sapiens
tttcagaaaagatta

SEQ ID NO: 477723 - DNA, 15 bp, Homo sapiens
ttcagaaaagattaa

SEQ ID NO: 477724 - DNA, 15 bp, Homo sapiens
tcagaaaagattaac

SEQ ID NO: 477725 - DNA, 15 bp, Homo sapiens
cagaaaagattaaca

SEQ ID NO: 477726 - DNA, 15 bp, Homo sapiens
agaaaagattaacat

SEQ ID NO: 477727 - DNA, 15 bp, Homo sapiens
gaaaagattaacatt

SEQ ID NO: 477728 - DNA, 15 bp, Homo sapiens
aaaagattaacattt

SEQ ID NO: 477729 - DNA, 15 bp, Homo sapiens
aaagattaacatttt

SEQ ID NO: 477730 - DNA, 15 bp, Homo sapiens
aagattaacattttt

SEQ ID NO: 477731 - DNA, 15 bp, Homo sapiens
agattaacatttttt

SEQ ID NO: 477732 - DNA, 15 bp, Homo sapiens
gattaacatttttta

SEQ ID NO: 477733 - DNA, 15 bp, Homo sapiens
attaacattttttaa

SEQ ID NO: 477734 - DNA, 15 bp, Homo sapiens
ttaacattttttaaa

SEQ ID NO: 477735 - DNA, 15 bp, Homo sapiens
taacattttttaaaa

SEQ ID NO: 477736 - DNA, 15 bp, Homo sapiens
acattttttaaaaag

SEQ ID NO: 477737 - DNA, 15 bp, Homo sapiens
cattttttaaaaaga

SEQ ID NO: 477738 - DNA, 15 bp, Homo sapiens
ttaaaaagaaaagaa

SEQ ID NO: 477739 - DNA, 15 bp, Homo sapiens
taaaaagaaaagaaa

SEQ ID NO: 477740 - DNA, 15 bp, Homo sapiens
aaaagaaaagaaaaa

SEQ ID NO: 477741 - DNA, 15 bp, Homo sapiens
aagaaaagaaaaaag

SEQ ID NO: 477742 - DNA, 15 bp, Homo sapiens
agaaaagaaaaaagt

SEQ ID NO: 477743 - DNA, 15 bp, Homo sapiens
gaaaagaaaaaagtc

SEQ ID NO: 477744 - DNA, 15 bp, Homo sapiens
aaaagaaaaaagtca

SEQ ID NO: 477745 - DNA, 15 bp, Homo sapiens
aaagaaaaaagtcag

SEQ ID NO: 477746 - DNA, 15 bp, Homo sapiens
aagaaaaaagtcaga

SEQ ID NO: 477747 - DNA, 15 bp, Homo sapiens
agaaaaaagtcagaa

SEQ ID NO: 477748 - DNA, 15 bp, Homo sapiens
gaaaaaagtcagaag

SEQ ID NO: 477749 - DNA, 15 bp, Homo sapiens
aaaaaagtcagaaga

SEQ ID NO: 477750 - DNA, 15 bp, Homo sapiens
aaaaagtcagaagat

SEQ ID NO: 477751 - DNA, 15 bp, Homo sapiens
aaaagtcagaagatt

SEQ ID NO: 477752 - DNA, 15 bp, Homo sapiens
aaagtcagaagatta

SEQ ID NO: 477753 - DNA, 15 bp, Homo sapiens
aagtcagaagattaa

SEQ ID NO: 477754 - DNA, 15 bp, Homo sapiens
agtcagaagattaac

SEQ ID NO: 477755 - DNA, 15 bp, Homo sapiens
gtcagaagattaaca

SEQ ID NO: 477756 - DNA, 15 bp, Homo sapiens
tcagaagattaacag

SEQ ID NO: 477757 - DNA, 15 bp, Homo sapiens
cagaagattaacagt

SEQ ID NO: 477758 - DNA, 15 bp, Homo sapiens
agaagattaacagtc

SEQ ID NO: 477759 - DNA, 15 bp, Homo sapiens
gaagattaacagtca

SEQ ID NO: 477760 - DNA, 15 bp, Homo sapiens
aagattaacagtcag

SEQ ID NO: 477761 - DNA, 15 bp, Homo sapiens
agattaacagtcaga

SEQ ID NO: 477762 - DNA, 15 bp, Homo sapiens
gattaacagtcagat

SEQ ID NO: 477763 - DNA, 15 bp, Homo sapiens
attaacagtcagata

SEQ ID NO: 477764 - DNA, 15 bp, Homo sapiens
ttaacagtcagatac

SEQ ID NO: 477765 - DNA, 15 bp, Homo sapiens
taacagtcagataca

SEQ ID NO: 477766 - DNA, 15 bp, Homo sapiens
aacagtcagatacat

SEQ ID NO: 477767 - DNA, 15 bp, Homo sapiens
acagtcagatacatt

SEQ ID NO: 477768 - DNA, 15 bp, Homo sapiens
cagtcagatacattt

SEQ ID NO: 477769 - DNA, 15 bp, Homo sapiens
agtcagatacatttt

SEQ ID NO: 477770 - DNA, 15 bp, Homo sapiens
gtcagatacatttta

SEQ ID NO: 477771 - DNA, 15 bp, Homo sapiens
tcagatacattttaa

SEQ ID NO: 477772 - DNA, 15 bp, Homo sapiens
cagatacattttaat

SEQ ID NO: 477773 - DNA, 15 bp, Homo sapiens
agatacattttaata

SEQ ID NO: 477774 - DNA, 15 bp, Homo sapiens
gatacattttaatat

SEQ ID NO: 477775 - DNA, 15 bp, Homo sapiens
atacattttaatata

SEQ ID NO: 477776 - DNA, 15 bp, Homo sapiens
tacattttaatatac

SEQ ID NO: 477777 - DNA, 15 bp, Homo sapiens
acattttaatatact

SEQ ID NO: 477778 - DNA, 15 bp, Homo sapiens
cattttaatatactg

SEQ ID NO: 477779 - DNA, 15 bp, Homo sapiens
attttaatatactgt

SEQ ID NO: 477780 - DNA, 15 bp, Homo sapiens
ttttaatatactgtc

SEQ ID NO: 477781 - DNA, 15 bp, Homo sapiens
tttaatatactgtca

SEQ ID NO: 477782 - DNA, 15 bp, Homo sapiens
ttaatatactgtcat

SEQ ID NO: 477783 - DNA, 15 bp, Homo sapiens
taatatactgtcatt

SEQ ID NO: 477784 - DNA, 15 bp, Homo sapiens
aatatactgtcatta

SEQ ID NO: 477785 - DNA, 15 bp, Homo sapiens
atatactgtcattat

SEQ ID NO: 477786 - DNA, 15 bp, Homo sapiens
tatactgtcattata

SEQ ID NO: 477787 - DNA, 15 bp, Homo sapiens
atactgtcattatat

SEQ ID NO: 477788 - DNA, 15 bp, Homo sapiens
tactgtcattatata

SEQ ID NO: 477789 - DNA, 15 bp, Homo sapiens
actgtcattatatat

SEQ ID NO: 477790 - DNA, 15 bp, Homo sapiens
ctgtcattatatata

SEQ ID NO: 477791 - DNA, 15 bp, Homo sapiens
tgtcattatatatat

SEQ ID NO: 477792 - DNA, 15 bp, Homo sapiens
gtcattatatatatt

SEQ ID NO: 477793 - DNA, 15 bp, Homo sapiens
tcattatatatatta

SEQ ID NO: 477794 - DNA, 15 bp, Homo sapiens
cattatatatattaa

SEQ ID NO: 477795 - DNA, 15 bp, Homo sapiens
attatatatattaac

SEQ ID NO: 477796 - DNA, 15 bp, Homo sapiens
ttatatatattaact

SEQ ID NO: 477797 - DNA, 15 bp, Homo sapiens
tatatatattaactc

SEQ ID NO: 477798 - DNA, 15 bp, Homo sapiens
atatatattaactca

SEQ ID NO: 477799 - DNA, 15 bp, Homo sapiens
tatatattaactcat

SEQ ID NO: 477800 - DNA, 15 bp, Homo sapiens
atatattaactcatt

SEQ ID NO: 477801 - DNA, 15 bp, Homo sapiens
tatattaactcattc

SEQ ID NO: 477802 - DNA, 15 bp, Homo sapiens
atattaactcattca

SEQ ID NO: 477803 - DNA, 15 bp, Homo sapiens
tattaactcattcac

SEQ ID NO: 477804 - DNA, 15 bp, Homo sapiens
attaactcattcacc

SEQ ID NO: 477805 - DNA, 15 bp, Homo sapiens
ttaactcattcaccc

SEQ ID NO: 477806 - DNA, 15 bp, Homo sapiens
taactcattcaccca

SEQ ID NO: 477807 - DNA, 15 bp, Homo sapiens
aactcattcacccat

SEQ ID NO: 477808 - DNA, 15 bp, Homo sapiens
actcattcacccatc

SEQ ID NO: 477809 - DNA, 15 bp, Homo sapiens
ctcattcacccatcc

SEQ ID NO: 477810 - DNA, 15 bp, Homo sapiens
tcattcacccatcca

SEQ ID NO: 477811 - DNA, 15 bp, Homo sapiens
cattcacccatccaa

SEQ ID NO: 477812 - DNA, 15 bp, Homo sapiens
attcacccatccaac

SEQ ID NO: 477813 - DNA, 15 bp, Homo sapiens
ttcacccatccaaca

SEQ ID NO: 477814 - DNA, 15 bp, Homo sapiens
tcacccatccaacag

SEQ ID NO: 477815 - DNA, 15 bp, Homo sapiens
cacccatccaacaga

SEQ ID NO: 477816 - DNA, 15 bp, Homo sapiens
acccatccaacagac

SEQ ID NO: 477817 - DNA, 15 bp, Homo sapiens
cccatccaacagaca

SEQ ID NO: 477818 - DNA, 15 bp, Homo sapiens
ccatccaacagacag

SEQ ID NO: 477819 - DNA, 15 bp, Homo sapiens
catccaacagacagt

SEQ ID NO: 477820 - DNA, 15 bp, Homo sapiens
atccaacagacagtt

SEQ ID NO: 477821 - DNA, 15 bp, Homo sapiens
tccaacagacagttg

SEQ ID NO: 477822 - DNA, 15 bp, Homo sapiens
ccaacagacagttgt

SEQ ID NO: 477823 - DNA, 15 bp, Homo sapiens
caacagacagttgtt

SEQ ID NO: 477824 - DNA, 15 bp, Homo sapiens
aacagacagttgtta

SEQ ID NO: 477825 - DNA, 15 bp, Homo sapiens
acagacagttgttat

SEQ ID NO: 477826 - DNA, 15 bp, Homo sapiens
cagacagttgttatt

SEQ ID NO: 477827 - DNA, 15 bp, Homo sapiens
agacagttgttatta

SEQ ID NO: 477828 - DNA, 15 bp, Homo sapiens
gacagttgttattaa

SEQ ID NO: 477829 - DNA, 15 bp, Homo sapiens
acagttgttattaat

SEQ ID NO: 477830 - DNA, 15 bp, Homo sapiens
cagttgttattaata

SEQ ID NO: 477831 - DNA, 15 bp, Homo sapiens
agttgttattaatat

SEQ ID NO: 477832 - DNA, 15 bp, Homo sapiens
gttgttattaatata

SEQ ID NO: 477833 - DNA, 15 bp, Homo sapiens
ttgttattaatatat

SEQ ID NO: 477834 - DNA, 15 bp, Homo sapiens
tgttattaatatata

SEQ ID NO: 477835 - DNA, 15 bp, Homo sapiens
ttattaatatatacc

SEQ ID NO: 477836 - DNA, 15 bp, Homo sapiens
tattaatatatacct

SEQ ID NO: 477837 - DNA, 15 bp, Homo sapiens
attaatatataccta

SEQ ID NO: 477838 - DNA, 15 bp, Homo sapiens
ttaatatatacctac

SEQ ID NO: 477839 - DNA, 15 bp, Homo sapiens
taatatatacctacc

SEQ ID NO: 477840 - DNA, 15 bp, Homo sapiens
aatatatacctacca

SEQ ID NO: 477841 - DNA, 15 bp, Homo sapiens
atatatacctaccat

SEQ ID NO: 477842 - DNA, 15 bp, Homo sapiens
tatatacctaccatg

SEQ ID NO: 477843 - DNA, 15 bp, Homo sapiens
atatacctaccatgt

SEQ ID NO: 477844 - DNA, 15 bp, Homo sapiens
tatacctaccatgta

SEQ ID NO: 477845 - DNA, 15 bp, Homo sapiens
atacctaccatgtaa

SEQ ID NO: 477846 - DNA, 15 bp, Homo sapiens
tacctaccatgtaat

SEQ ID NO: 477847 - DNA, 15 bp, Homo sapiens
acctaccatgtaatg

SEQ ID NO: 477848 - DNA, 15 bp, Homo sapiens
cctaccatgtaatgg

SEQ ID NO: 477849 - DNA, 15 bp, Homo sapiens
ctaccatgtaatggt

SEQ ID NO: 477850 - DNA, 15 bp, Homo sapiens
taccatgtaatggta

SEQ ID NO: 477851 - DNA, 15 bp, Homo sapiens
accatgtaatggtat

SEQ ID NO: 477852 - DNA, 15 bp, Homo sapiens
ccatgtaatggtatg

SEQ ID NO: 477853 - DNA, 15 bp, Homo sapiens
catgtaatggtatgc

SEQ ID NO: 477854 - DNA, 15 bp, Homo sapiens
atgtaatggtatgct

SEQ ID NO: 477855 - DNA, 15 bp, Homo sapiens
tgtaatggtatgctg

SEQ ID NO: 477856 - DNA, 15 bp, Homo sapiens
gtaatggtatgctgg

SEQ ID NO: 477857 - DNA, 15 bp, Homo sapiens
taatggtatgctgga

SEQ ID NO: 477858 - DNA, 15 bp, Homo sapiens
aatggtatgctggag

SEQ ID NO: 477859 - DNA, 15 bp, Homo sapiens
atggtatgctggagc

SEQ ID NO: 477860 - DNA, 15 bp, Homo sapiens
tggtatgctggagcc

SEQ ID NO: 477861 - DNA, 15 bp, Homo sapiens
ggtatgctggagcca

SEQ ID NO: 477862 - DNA, 15 bp, Homo sapiens
gtatgctggagccaa

SEQ ID NO: 477863 - DNA, 15 bp, Homo sapiens
tatgctggagccaat

SEQ ID NO: 477864 - DNA, 15 bp, Homo sapiens
atgctggagccaatt

SEQ ID NO: 477865 - DNA, 15 bp, Homo sapiens
tgctggagccaattg

SEQ ID NO: 477866 - DNA, 15 bp, Homo sapiens
gctggagccaattgt

SEQ ID NO: 477867 - DNA, 15 bp, Homo sapiens
ctggagccaattgtg

SEQ ID NO: 477868 - DNA, 15 bp, Homo sapiens
tggagccaattgtga

SEQ ID NO: 477869 - DNA, 15 bp, Homo sapiens
ggagccaattgtgag

SEQ ID NO: 477870 - DNA, 15 bp, Homo sapiens
gagccaattgtgaga

SEQ ID NO: 477871 - DNA, 15 bp, Homo sapiens
agccaattgtgagag

SEQ ID NO: 477872 - DNA, 15 bp, Homo sapiens
gccaattgtgagagc

SEQ ID NO: 477873 - DNA, 15 bp, Homo sapiens
ccaattgtgagagct

SEQ ID NO: 477874 - DNA, 15 bp, Homo sapiens
caattgtgagagctg

SEQ ID NO: 477875 - DNA, 15 bp, Homo sapiens
aattgtgagagctga

SEQ ID NO: 477876 - DNA, 15 bp, Homo sapiens
attgtgagagctgat

SEQ ID NO: 477877 - DNA, 15 bp, Homo sapiens
ttgtgagagctgatt

SEQ ID NO: 477878 - DNA, 15 bp, Homo sapiens
tgtgagagctgattg

SEQ ID NO: 477879 - DNA, 15 bp, Homo sapiens
gtgagagctgattgt

SEQ ID NO: 477880 - DNA, 15 bp, Homo sapiens
tgagagctgattgtt

SEQ ID NO: 477881 - DNA, 15 bp, Homo sapiens
gagagctgattgtta

SEQ ID NO: 477882 - DNA, 15 bp, Homo sapiens
agagctgattgttac

SEQ ID NO: 477883 - DNA, 15 bp, Homo sapiens
gagctgattgttaca

SEQ ID NO: 477884 - DNA, 15 bp, Homo sapiens
agctgattgttacat

SEQ ID NO: 477885 - DNA, 15 bp, Homo sapiens
gctgattgttacatt

SEQ ID NO: 477886 - DNA, 15 bp, Homo sapiens
ctgattgttacattt

SEQ ID NO: 477887 - DNA, 15 bp, Homo sapiens
tgattgttacatttt

SEQ ID NO: 477888 - DNA, 15 bp, Homo sapiens
gattgttacattttc

SEQ ID NO: 477889 - DNA, 15 bp, Homo sapiens
attgttacattttca

SEQ ID NO: 477890 - DNA, 15 bp, Homo sapiens
ttgttacattttcag

SEQ ID NO: 477891 - DNA, 15 bp, Homo sapiens
tgttacattttcagg

SEQ ID NO: 477892 - DNA, 15 bp, Homo sapiens
gttacattttcagga

SEQ ID NO: 477893 - DNA, 15 bp, Homo sapiens
ttacattttcaggat

SEQ ID NO: 477894 - DNA, 15 bp, Homo sapiens
tacattttcaggatg

SEQ ID NO: 477895 - DNA, 15 bp, Homo sapiens
acattttcaggatgt

SEQ ID NO: 477896 - DNA, 15 bp, Homo sapiens
cattttcaggatgtt

SEQ ID NO: 477897 - DNA, 15 bp, Homo sapiens
attttcaggatgttt

SEQ ID NO: 477898 - DNA, 15 bp, Homo sapiens
ttttcaggatgtttg

SEQ ID NO: 477899 - DNA, 15 bp, Homo sapiens
tttcaggatgtttgt

SEQ ID NO: 477900 - DNA, 15 bp, Homo sapiens
ttcaggatgtttgta

SEQ ID NO: 477901 - DNA, 15 bp, Homo sapiens
tcaggatgtttgtaa

SEQ ID NO: 477902 - DNA, 15 bp, Homo sapiens
caggatgtttgtaag

SEQ ID NO: 477903 - DNA, 15 bp, Homo sapiens
aggatgtttgtaagc

SEQ ID NO: 477904 - DNA, 15 bp, Homo sapiens
ggatgtttgtaagct

SEQ ID NO: 477905 - DNA, 15 bp, Homo sapiens
gatgtttgtaagctg

SEQ ID NO: 477906 - DNA, 15 bp, Homo sapiens
atgtttgtaagctgt

SEQ ID NO: 477907 - DNA, 15 bp, Homo sapiens
tgtttgtaagctgtt

SEQ ID NO: 477908 - DNA, 15 bp, Homo sapiens
gtttgtaagctgtta

SEQ ID NO: 477909 - DNA, 15 bp, Homo sapiens
tttgtaagctgttaa

SEQ ID NO: 477910 - DNA, 15 bp, Homo sapiens
ttgtaagctgttaaa

SEQ ID NO: 477911 - DNA, 15 bp, Homo sapiens
tgtaagctgttaaac

SEQ ID NO: 477912 - DNA, 15 bp, Homo sapiens
gtaagctgttaaaca

SEQ ID NO: 477913 - DNA, 15 bp, Homo sapiens
taagctgttaaacag

SEQ ID NO: 477914 - DNA, 15 bp, Homo sapiens
aagctgttaaacaga

SEQ ID NO: 477915 - DNA, 15 bp, Homo sapiens
agctgttaaacagag

SEQ ID NO: 477916 - DNA, 15 bp, Homo sapiens
gctgttaaacagagc

SEQ ID NO: 477917 - DNA, 15 bp, Homo sapiens
ctgttaaacagagcc

SEQ ID NO: 477918 - DNA, 15 bp, Homo sapiens
tgttaaacagagcct

SEQ ID NO: 477919 - DNA, 15 bp, Homo sapiens
gttaaacagagcctt

SEQ ID NO: 477920 - DNA, 15 bp, Homo sapiens
ttaaacagagccttt

SEQ ID NO: 477921 - DNA, 15 bp, Homo sapiens
taaacagagcctttt

SEQ ID NO: 477922 - DNA, 15 bp, Homo sapiens
aaacagagccttttt

SEQ ID NO: 477923 - DNA, 15 bp, Homo sapiens
aacagagccttttta

SEQ ID NO: 477924 - DNA, 15 bp, Homo sapiens
acagagcctttttaa

SEQ ID NO: 477925 - DNA, 15 bp, Homo sapiens
cagagcctttttaaa

SEQ ID NO: 477926 - DNA, 15 bp, Homo sapiens
agagcctttttaaaa

SEQ ID NO: 477927 - DNA, 15 bp, Homo sapiens
gagcctttttaaaaa

SEQ ID NO: 477928 - DNA, 15 bp, Homo sapiens
agcctttttaaaaat

SEQ ID NO: 477929 - DNA, 15 bp, Homo sapiens
gcctttttaaaaata

SEQ ID NO: 477930 - DNA, 15 bp, Homo sapiens
cctttttaaaaataa

SEQ ID NO: 477931 - DNA, 15 bp, Homo sapiens
ctttttaaaaataat

SEQ ID NO: 477932 - DNA, 15 bp, Homo sapiens
tttttaaaaataatt

SEQ ID NO: 477933 - DNA, 15 bp, Homo sapiens
ttttaaaaataattt

SEQ ID NO: 477934 - DNA, 15 bp, Homo sapiens
tttaaaaataattta

SEQ ID NO: 477935 - DNA, 15 bp, Homo sapiens
ttaaaaataatttat

SEQ ID NO: 477936 - DNA, 15 bp, Homo sapiens
taaaaataatttata

SEQ ID NO: 477937 - DNA, 15 bp, Homo sapiens
aaaaataatttatat

SEQ ID NO: 477938 - DNA, 15 bp, Homo sapiens
aaaataatttatata

SEQ ID NO: 477939 - DNA, 15 bp, Homo sapiens
aaataatttatatac

SEQ ID NO: 477940 - DNA, 15 bp, Homo sapiens
aataatttatataca

SEQ ID NO: 477941 - DNA, 15 bp, Homo sapiens
ataatttatatacat

SEQ ID NO: 477942 - DNA, 15 bp, Homo sapiens
taatttatatacatg

SEQ ID NO: 477943 - DNA, 15 bp, Homo sapiens
aatttatatacatgt

SEQ ID NO: 477944 - DNA, 15 bp, Homo sapiens
atttatatacatgta

SEQ ID NO: 477945 - DNA, 15 bp, Homo sapiens
tttatatacatgtat

SEQ ID NO: 477946 - DNA, 15 bp, Homo sapiens
ttatatacatgtata

SEQ ID NO: 477947 - DNA, 15 bp, Homo sapiens
tatacatgtatatac

SEQ ID NO: 477948 - DNA, 15 bp, Homo sapiens
atacatgtatataca

SEQ ID NO: 477949 - DNA, 15 bp, Homo sapiens
tacatgtatatacag

SEQ ID NO: 477950 - DNA, 15 bp, Homo sapiens
acatgtatatacagt

SEQ ID NO: 477951 - DNA, 15 bp, Homo sapiens
catgtatatacagtt

SEQ ID NO: 477952 - DNA, 15 bp, Homo sapiens
atgtatatacagtta

SEQ ID NO: 477953 - DNA, 15 bp, Homo sapiens
tgtatatacagttac

SEQ ID NO: 477954 - DNA, 15 bp, Homo sapiens
gtatatacagttaca

SEQ ID NO: 477955 - DNA, 15 bp, Homo sapiens
tatatacagttacaa

SEQ ID NO: 477956 - DNA, 15 bp, Homo sapiens
atatacagttacaat

SEQ ID NO: 477957 - DNA, 15 bp, Homo sapiens
tatacagttacaatt

SEQ ID NO: 477958 - DNA, 15 bp, Homo sapiens
atacagttacaatta

SEQ ID NO: 477959 - DNA, 15 bp, Homo sapiens
tacagttacaattaa

SEQ ID NO: 477960 - DNA, 15 bp, Homo sapiens
acagttacaattaaa

SEQ ID NO: 477961 - DNA, 15 bp, Homo sapiens
cagttacaattaaat

SEQ ID NO: 477962 - DNA, 15 bp, Homo sapiens
agttacaattaaata

SEQ ID NO: 477963 - DNA, 15 bp, Homo sapiens
gttacaattaaataa

SEQ ID NO: 477964 - DNA, 15 bp, Homo sapiens
ttacaattaaataaa

SEQ ID NO: 477965 - DNA, 15 bp, Homo sapiens
tacaattaaataaat

SEQ ID NO: 477966 - DNA, 15 bp, Homo sapiens
acaattaaataaatt

SEQ ID NO: 477967 - DNA, 15 bp, Homo sapiens
caattaaataaatta

SEQ ID NO: 477968 - DNA, 15 bp, Homo sapiens
aattaaataaattag

SEQ ID NO: 477969 - DNA, 15 bp, Homo sapiens
attaaataaattaga

SEQ ID NO: 477970 - DNA, 15 bp, Homo sapiens
ttaaataaattagat

SEQ ID NO: 477971 - DNA, 15 bp, Homo sapiens
taaataaattagatt

SEQ ID NO: 477972 - DNA, 15 bp, Homo sapiens
aaataaattagatta

SEQ ID NO: 477973 - DNA, 15 bp, Homo sapiens
aataaattagattaa

SEQ ID NO: 477974 - DNA, 15 bp, Homo sapiens
ataaattagattaaa

SEQ ID NO: 477975 - DNA, 15 bp, Homo sapiens
taaattagattaaaa

SEQ ID NO: 477976 - DNA, 15 bp, Homo sapiens
aaattagattaaaac

SEQ ID NO: 477977 - DNA, 15 bp, Homo sapiens
aattagattaaaaca

SEQ ID NO: 477978 - DNA, 15 bp, Homo sapiens
attagattaaaacaa

SEQ ID NO: 477979 - DNA, 15 bp, Homo sapiens
ttagattaaaacaaa

SEQ ID NO: 477980 - DNA, 15 bp, Homo sapiens
tagattaaaacaaaa

SEQ ID NO: 477981 - DNA, 15 bp, Homo sapiens
agattaaaacaaaaa

SEQ ID NO: 477982 - DNA, 15 bp, Homo sapiens
gattaaaacaaaaac

SEQ ID NO: 477983 - DNA, 15 bp, Homo sapiens
ttaaaacaaaaacaa

SEQ ID NO: 477984 - DNA, 15 bp, Homo sapiens
aacaaaaacaaaagt

SEQ ID NO: 477985 - DNA, 15 bp, Homo sapiens
acaaaaacaaaagta

SEQ ID NO: 477986 - DNA, 15 bp, Homo sapiens
caaaaacaaaagtaa

SEQ ID NO: 477987 - DNA, 15 bp, Homo sapiens
aaaaacaaaagtaat

SEQ ID NO: 477988 - DNA, 15 bp, Homo sapiens
aaaacaaaagtaatt

SEQ ID NO: 477989 - DNA, 15 bp, Homo sapiens
aaacaaaagtaattc

SEQ ID NO: 477990 - DNA, 15 bp, Homo sapiens
aacaaaagtaattct

SEQ ID NO: 477991 - DNA, 15 bp, Homo sapiens
acaaaagtaattctc

SEQ ID NO: 477992 - DNA, 15 bp, Homo sapiens
caaaagtaattctca

SEQ ID NO: 477993 - DNA, 15 bp, Homo sapiens
aaaagtaattctcaa

SEQ ID NO: 477994 - DNA, 15 bp, Homo sapiens
aaagtaattctcaaa

SEQ ID NO: 477995 - DNA, 15 bp, Homo sapiens
aagtaattctcaaaa

SEQ ID NO: 477996 - DNA, 15 bp, Homo sapiens
agtaattctcaaaac

SEQ ID NO: 477997 - DNA, 15 bp, Homo sapiens
gtaattctcaaaact

SEQ ID NO: 477998 - DNA, 15 bp, Homo sapiens
taattctcaaaactc

SEQ ID NO: 477999 - DNA, 15 bp, Homo sapiens
aattctcaaaactca

SEQ ID NO: 478000 - DNA, 15 bp, Homo sapiens
attctcaaaactcat

SEQ ID NO: 478001 - DNA, 15 bp, Homo sapiens
ttctcaaaactcatc

SEQ ID NO: 478002 - DNA, 15 bp, Homo sapiens
tctcaaaactcatca

SEQ ID NO: 478003 - DNA, 15 bp, Homo sapiens
ctcaaaactcatcac

SEQ ID NO: 478004 - DNA, 15 bp, Homo sapiens
tcaaaactcatcaca

SEQ ID NO: 478005 - DNA, 15 bp, Homo sapiens
caaaactcatcacac

SEQ ID NO: 478006 - DNA, 15 bp, Homo sapiens
aaaactcatcacacc

SEQ ID NO: 478007 - DNA, 15 bp, Homo sapiens
aaactcatcacaccc

SEQ ID NO: 478008 - DNA, 15 bp, Homo sapiens
aactcatcacaccct

SEQ ID NO: 478009 - DNA, 15 bp, Homo sapiens
actcatcacacccta

SEQ ID NO: 478010 - DNA, 15 bp, Homo sapiens
ctcatcacaccctaa

SEQ ID NO: 478011 - DNA, 15 bp, Homo sapiens
tcatcacaccctaat

SEQ ID NO: 478012 - DNA, 15 bp, Homo sapiens
catcacaccctaatg

SEQ ID NO: 478013 - DNA, 15 bp, Homo sapiens
atcacaccctaatga

SEQ ID NO: 478014 - DNA, 15 bp, Homo sapiens
tcacaccctaatgat

SEQ ID NO: 478015 - DNA, 15 bp, Homo sapiens
cacaccctaatgatt

SEQ ID NO: 478016 - DNA, 15 bp, Homo sapiens
acaccctaatgattt

SEQ ID NO: 478017 - DNA, 15 bp, Homo sapiens
caccctaatgatttt

SEQ ID NO: 478018 - DNA, 15 bp, Homo sapiens
accctaatgatttta

SEQ ID NO: 478019 - DNA, 15 bp, Homo sapiens
ccctaatgattttac

SEQ ID NO: 478020 - DNA, 15 bp, Homo sapiens
cctaatgattttact

SEQ ID NO: 478021 - DNA, 15 bp, Homo sapiens
ctaatgattttactt

SEQ ID NO: 478022 - DNA, 15 bp, Homo sapiens
taatgattttacttc

SEQ ID NO: 478023 - DNA, 15 bp, Homo sapiens
aatgattttacttca

SEQ ID NO: 478024 - DNA, 15 bp, Homo sapiens
atgattttacttcat

SEQ ID NO: 478025 - DNA, 15 bp, Homo sapiens
tgattttacttcatt

SEQ ID NO: 478026 - DNA, 15 bp, Homo sapiens
gattttacttcattt

SEQ ID NO: 478027 - DNA, 15 bp, Homo sapiens
attttacttcatttc

SEQ ID NO: 478028 - DNA, 15 bp, Homo sapiens
ttttacttcatttca

SEQ ID NO: 478029 - DNA, 15 bp, Homo sapiens
tttacttcatttcac

SEQ ID NO: 478030 - DNA, 15 bp, Homo sapiens
ttacttcatttcact

SEQ ID NO: 478031 - DNA, 15 bp, Homo sapiens
tacttcatttcacta

SEQ ID NO: 478032 - DNA, 15 bp, Homo sapiens
acttcatttcactaa

SEQ ID NO: 478033 - DNA, 15 bp, Homo sapiens
cttcatttcactaat

SEQ ID NO: 478034 - DNA, 15 bp, Homo sapiens
ttcatttcactaata

SEQ ID NO: 478035 - DNA, 15 bp, Homo sapiens
tcatttcactaatat

SEQ ID NO: 478036 - DNA, 15 bp, Homo sapiens
catttcactaatatc

SEQ ID NO: 478037 - DNA, 15 bp, Homo sapiens
atttcactaatatct

SEQ ID NO: 478038 - DNA, 15 bp, Homo sapiens
tttcactaatatcta

SEQ ID NO: 478039 - DNA, 15 bp, Homo sapiens
ttcactaatatctat

SEQ ID NO: 478040 - DNA, 15 bp, Homo sapiens
tcactaatatctatg

SEQ ID NO: 478041 - DNA, 15 bp, Homo sapiens
cactaatatctatgc

SEQ ID NO: 478042 - DNA, 15 bp, Homo sapiens
actaatatctatgcc

SEQ ID NO: 478043 - DNA, 15 bp, Homo sapiens
ctaatatctatgccc

SEQ ID NO: 478044 - DNA, 15 bp, Homo sapiens
taatatctatgccct

SEQ ID NO: 478045 - DNA, 15 bp, Homo sapiens
aatatctatgccctt

SEQ ID NO: 478046 - DNA, 15 bp, Homo sapiens
atatctatgcccttg

SEQ ID NO: 478047 - DNA, 15 bp, Homo sapiens
tatctatgcccttgg

SEQ ID NO: 478048 - DNA, 15 bp, Homo sapiens
atctatgcccttggg

SEQ ID NO: 478049 - DNA, 15 bp, Homo sapiens
tctatgcccttggga

SEQ ID NO: 478050 - DNA, 15 bp, Homo sapiens
ctatgcccttgggat

SEQ ID NO: 478051 - DNA, 15 bp, Homo sapiens
tatgcccttgggatt

SEQ ID NO: 478052 - DNA, 15 bp, Homo sapiens
atgcccttgggatta

SEQ ID NO: 478053 - DNA, 15 bp, Homo sapiens
tgcccttgggattat

SEQ ID NO: 478054 - DNA, 15 bp, Homo sapiens
gcccttgggattatt

SEQ ID NO: 478055 - DNA, 15 bp, Homo sapiens
cccttgggattattt

SEQ ID NO: 478056 - DNA, 15 bp, Homo sapiens
ccttgggattattta

SEQ ID NO: 478057 - DNA, 15 bp, Homo sapiens
cttgggattatttat

SEQ ID NO: 478058 - DNA, 15 bp, Homo sapiens
ttgggattatttatt

SEQ ID NO: 478059 - DNA, 15 bp, Homo sapiens
tgggattatttatta

SEQ ID NO: 478060 - DNA, 15 bp, Homo sapiens
gggattatttattat

SEQ ID NO: 478061 - DNA, 15 bp, Homo sapiens
ggattatttattata

SEQ ID NO: 478062 - DNA, 15 bp, Homo sapiens
gattatttattataa

SEQ ID NO: 478063 - DNA, 15 bp, Homo sapiens
attatttattataaa

SEQ ID NO: 478064 - DNA, 15 bp, Homo sapiens
ttatttattataaac

SEQ ID NO: 478065 - DNA, 15 bp, Homo sapiens
tatttattataaact

SEQ ID NO: 478066 - DNA, 15 bp, Homo sapiens
atttattataaactt

SEQ ID NO: 478067 - DNA, 15 bp, Homo sapiens
tttattataaacttg

SEQ ID NO: 478068 - DNA, 15 bp, Homo sapiens
ttattataaacttgt

SEQ ID NO: 478069 - DNA, 15 bp, Homo sapiens
tattataaacttgtc

SEQ ID NO: 478070 - DNA, 15 bp, Homo sapiens
attataaacttgtcc

SEQ ID NO: 478071 - DNA, 15 bp, Homo sapiens
ttataaacttgtcca

SEQ ID NO: 478072 - DNA, 15 bp, Homo sapiens
tataaacttgtccat

SEQ ID NO: 478073 - DNA, 15 bp, Homo sapiens
ataaacttgtccatc

SEQ ID NO: 478074 - DNA, 15 bp, Homo sapiens
taaacttgtccatcc

SEQ ID NO: 478075 - DNA, 15 bp, Homo sapiens
aaacttgtccatcct

SEQ ID NO: 478076 - DNA, 15 bp, Homo sapiens
aacttgtccatcctg

SEQ ID NO: 478077 - DNA, 15 bp, Homo sapiens
acttgtccatcctgc

SEQ ID NO: 478078 - DNA, 15 bp, Homo sapiens
cttgtccatcctgca

SEQ ID NO: 478079 - DNA, 15 bp, Homo sapiens
ttgtccatcctgcaa

SEQ ID NO: 478080 - DNA, 15 bp, Homo sapiens
tgtccatcctgcaac

SEQ ID NO: 478081 - DNA, 15 bp, Homo sapiens
gtccatcctgcaacc

SEQ ID NO: 478082 - DNA, 15 bp, Homo sapiens
tccatcctgcaaccc

SEQ ID NO: 478083 - DNA, 15 bp, Homo sapiens
ccatcctgcaaccca

SEQ ID NO: 478084 - DNA, 15 bp, Homo sapiens
catcctgcaacccac

SEQ ID NO: 478085 - DNA, 15 bp, Homo sapiens
atcctgcaacccaca

SEQ ID NO: 478086 - DNA, 15 bp, Homo sapiens
tcctgcaacccacag

SEQ ID NO: 478087 - DNA, 15 bp, Homo sapiens
cctgcaacccacagg

SEQ ID NO: 478088 - DNA, 15 bp, Homo sapiens
ctgcaacccacaggc

SEQ ID NO: 478089 - DNA, 15 bp, Homo sapiens
tgcaacccacaggcc

SEQ ID NO: 478090 - DNA, 15 bp, Homo sapiens
gcaacccacaggcca

SEQ ID NO: 478091 - DNA, 15 bp, Homo sapiens
caacccacaggccac

SEQ ID NO: 478092 - DNA, 15 bp, Homo sapiens
aacccacaggccaca

SEQ ID NO: 478093 - DNA, 15 bp, Homo sapiens
acccacaggccacat

SEQ ID NO: 478094 - DNA, 15 bp, Homo sapiens
cccacaggccacatg

SEQ ID NO: 478095 - DNA, 15 bp, Homo sapiens
ccacaggccacatgt

SEQ ID NO: 478096 - DNA, 15 bp, Homo sapiens
cacaggccacatgtg

SEQ ID NO: 478097 - DNA, 15 bp, Homo sapiens
acaggccacatgtgg

SEQ ID NO: 478098 - DNA, 15 bp, Homo sapiens
caggccacatgtggc

SEQ ID NO: 478099 - DNA, 15 bp, Homo sapiens
aggccacatgtggcc

SEQ ID NO: 478100 - DNA, 15 bp, Homo sapiens
ggccacatgtggccc

SEQ ID NO: 478101 - DNA, 15 bp, Homo sapiens
gccacatgtggccca

SEQ ID NO: 478102 - DNA, 15 bp, Homo sapiens
ccacatgtggcccag

SEQ ID NO: 478103 - DNA, 15 bp, Homo sapiens
cacatgtggcccagg

SEQ ID NO: 478104 - DNA, 15 bp, Homo sapiens
acatgtggcccagga

SEQ ID NO: 478105 - DNA, 15 bp, Homo sapiens
catgtggcccaggac

SEQ ID NO: 478106 - DNA, 15 bp, Homo sapiens
atgtggcccaggaca

SEQ ID NO: 478107 - DNA, 15 bp, Homo sapiens
tgtggcccaggacag

SEQ ID NO: 478108 - DNA, 15 bp, Homo sapiens
gtggcccaggacagc

SEQ ID NO: 478109 - DNA, 15 bp, Homo sapiens
tggcccaggacagct

SEQ ID NO: 478110 - DNA, 15 bp, Homo sapiens
ggcccaggacagctt

SEQ ID NO: 478111 - DNA, 15 bp, Homo sapiens
gcccaggacagcttt

SEQ ID NO: 478112 - DNA, 15 bp, Homo sapiens
cccaggacagctttg

SEQ ID NO: 478113 - DNA, 15 bp, Homo sapiens
ccaggacagctttga

SEQ ID NO: 478114 - DNA, 15 bp, Homo sapiens
caggacagctttgaa

SEQ ID NO: 478115 - DNA, 15 bp, Homo sapiens
aggacagctttgaat

SEQ ID NO: 478116 - DNA, 15 bp, Homo sapiens
ggacagctttgaatg

SEQ ID NO: 478117 - DNA, 15 bp, Homo sapiens
gacagctttgaatgc

SEQ ID NO: 478118 - DNA, 15 bp, Homo sapiens
acagctttgaatgca

SEQ ID NO: 478119 - DNA, 15 bp, Homo sapiens
cagctttgaatgcag

SEQ ID NO: 478120 - DNA, 15 bp, Homo sapiens
agctttgaatgcagc

SEQ ID NO: 478121 - DNA, 15 bp, Homo sapiens
gctttgaatgcagcc

SEQ ID NO: 478122 - DNA, 15 bp, Homo sapiens
ctttgaatgcagccc

SEQ ID NO: 478123 - DNA, 15 bp, Homo sapiens
tttgaatgcagccca

SEQ ID NO: 478124 - DNA, 15 bp, Homo sapiens
ttgaatgcagcccaa

SEQ ID NO: 478125 - DNA, 15 bp, Homo sapiens
tgaatgcagcccaac

SEQ ID NO: 478126 - DNA, 15 bp, Homo sapiens
gaatgcagcccaaca

SEQ ID NO: 478127 - DNA, 15 bp, Homo sapiens
aatgcagcccaacac

SEQ ID NO: 478128 - DNA, 15 bp, Homo sapiens
atgcagcccaacaca

SEQ ID NO: 478129 - DNA, 15 bp, Homo sapiens
tgcagcccaacacaa

SEQ ID NO: 478130 - DNA, 15 bp, Homo sapiens
gcagcccaacacaaa

SEQ ID NO: 478131 - DNA, 15 bp, Homo sapiens
cagcccaacacaaat

SEQ ID NO: 478132 - DNA, 15 bp, Homo sapiens
agcccaacacaaatt

SEQ ID NO: 478133 - DNA, 15 bp, Homo sapiens
gcccaacacaaattc

SEQ ID NO: 478134 - DNA, 15 bp, Homo sapiens
cccaacacaaattca

SEQ ID NO: 478135 - DNA, 15 bp, Homo sapiens
ccaacacaaattcat

SEQ ID NO: 478136 - DNA, 15 bp, Homo sapiens
caacacaaattcata

SEQ ID NO: 478137 - DNA, 15 bp, Homo sapiens
aacacaaattcataa

SEQ ID NO: 478138 - DNA, 15 bp, Homo sapiens
acacaaattcataaa

SEQ ID NO: 478139 - DNA, 15 bp, Homo sapiens
cacaaattcataaac

SEQ ID NO: 478140 - DNA, 15 bp, Homo sapiens
acaaattcataaact

SEQ ID NO: 478141 - DNA, 15 bp, Homo sapiens
caaattcataaactt

SEQ ID NO: 478142 - DNA, 15 bp, Homo sapiens
aaattcataaacttt

SEQ ID NO: 478143 - DNA, 15 bp, Homo sapiens
aattcataaactttc

SEQ ID NO: 478144 - DNA, 15 bp, Homo sapiens
attcataaactttct

SEQ ID NO: 478145 - DNA, 15 bp, Homo sapiens
ttcataaactttctg

SEQ ID NO: 478146 - DNA, 15 bp, Homo sapiens
tcataaactttctga

SEQ ID NO: 478147 - DNA, 15 bp, Homo sapiens
cataaactttctgaa

SEQ ID NO: 478148 - DNA, 15 bp, Homo sapiens
ataaactttctgaaa

SEQ ID NO: 478149 - DNA, 15 bp, Homo sapiens
taaactttctgaaaa

SEQ ID NO: 478150 - DNA, 15 bp, Homo sapiens
aaactttctgaaaac

SEQ ID NO: 478151 - DNA, 15 bp, Homo sapiens
aactttctgaaaaca

SEQ ID NO: 478152 - DNA, 15 bp, Homo sapiens
actttctgaaaacat

SEQ ID NO: 478153 - DNA, 15 bp, Homo sapiens
ctttctgaaaacatt

SEQ ID NO: 478154 - DNA, 15 bp, Homo sapiens
tttctgaaaacatta

SEQ ID NO: 478155 - DNA, 15 bp, Homo sapiens
ttctgaaaacattat

SEQ ID NO: 478156 - DNA, 15 bp, Homo sapiens
tctgaaaacattata

SEQ ID NO: 478157 - DNA, 15 bp, Homo sapiens
ctgaaaacattataa

SEQ ID NO: 478158 - DNA, 15 bp, Homo sapiens
tgaaaacattataag

SEQ ID NO: 478159 - DNA, 15 bp, Homo sapiens
gaaaacattataaga

SEQ ID NO: 478160 - DNA, 15 bp, Homo sapiens
aaaacattataagat

SEQ ID NO: 478161 - DNA, 15 bp, Homo sapiens
aaacattataagatt

SEQ ID NO: 478162 - DNA, 15 bp, Homo sapiens
aacattataagattt

SEQ ID NO: 478163 - DNA, 15 bp, Homo sapiens
acattataagatttg

SEQ ID NO: 478164 - DNA, 15 bp, Homo sapiens
cattataagatttgt

SEQ ID NO: 478165 - DNA, 15 bp, Homo sapiens
attataagatttgtc

SEQ ID NO: 478166 - DNA, 15 bp, Homo sapiens
ttataagatttgtct

SEQ ID NO: 478167 - DNA, 15 bp, Homo sapiens
tataagatttgtctg

SEQ ID NO: 478168 - DNA, 15 bp, Homo sapiens
ataagatttgtctgt

SEQ ID NO: 478169 - DNA, 15 bp, Homo sapiens
taagatttgtctgtg

SEQ ID NO: 478170 - DNA, 15 bp, Homo sapiens
aagatttgtctgtga

SEQ ID NO: 478171 - DNA, 15 bp, Homo sapiens
agatttgtctgtgat

SEQ ID NO: 478172 - DNA, 15 bp, Homo sapiens
gatttgtctgtgatt

SEQ ID NO: 478173 - DNA, 15 bp, Homo sapiens
atttgtctgtgattt

SEQ ID NO: 478174 - DNA, 15 bp, Homo sapiens
tttgtctgtgatttg

SEQ ID NO: 478175 - DNA, 15 bp, Homo sapiens
ttgtctgtgatttgt

SEQ ID NO: 478176 - DNA, 15 bp, Homo sapiens
tgtctgtgatttgtt

SEQ ID NO: 478177 - DNA, 15 bp, Homo sapiens
gtctgtgatttgttt

SEQ ID NO: 478178 - DNA, 15 bp, Homo sapiens
tctgtgatttgtttt

SEQ ID NO: 478179 - DNA, 15 bp, Homo sapiens
ctgtgatttgttttt

SEQ ID NO: 478180 - DNA, 15 bp, Homo sapiens
tgtgatttgtttttt

SEQ ID NO: 478181 - DNA, 15 bp, Homo sapiens
gtgatttgttttttg

SEQ ID NO: 478182 - DNA, 15 bp, Homo sapiens
tgatttgttttttgt

SEQ ID NO: 478183 - DNA, 15 bp, Homo sapiens
gatttgttttttgtt

SEQ ID NO: 478184 - DNA, 15 bp, Homo sapiens
atttgttttttgttt

SEQ ID NO: 478185 - DNA, 15 bp, Homo sapiens
ttgttttttgttttt

SEQ ID NO: 478186 - DNA, 15 bp, Homo sapiens
tgttttttgtttttt

SEQ ID NO: 478187 - DNA, 15 bp, Homo sapiens
gttttttgttttttg

SEQ ID NO: 478188 - DNA, 15 bp, Homo sapiens
gttttttgttttttt

SEQ ID NO: 478189 - DNA, 15 bp, Homo sapiens
tttgttttttttttg

SEQ ID NO: 478190 - DNA, 15 bp, Homo sapiens
ttgttttttttttgc

SEQ ID NO: 478191 - DNA, 15 bp, Homo sapiens
tgttttttttttgct

SEQ ID NO: 478192 - DNA, 15 bp, Homo sapiens
gttttttttttgctt

SEQ ID NO: 478193 - DNA, 15 bp, Homo sapiens
ttttttttgcttttt

SEQ ID NO: 478194 - DNA, 15 bp, Homo sapiens
tttttttgctttttt

SEQ ID NO: 478195 - DNA, 15 bp, Homo sapiens
ttttttgctttttta

SEQ ID NO: 478196 - DNA, 15 bp, Homo sapiens
tttttgcttttttag

SEQ ID NO: 478197 - DNA, 15 bp, Homo sapiens
ttttgcttttttagc

SEQ ID NO: 478198 - DNA, 15 bp, Homo sapiens
tttgcttttttagct

SEQ ID NO: 478199 - DNA, 15 bp, Homo sapiens
ttgcttttttagctc

SEQ ID NO: 478200 - DNA, 15 bp, Homo sapiens
tgcttttttagctca

SEQ ID NO: 478201 - DNA, 15 bp, Homo sapiens
gcttttttagctcat

SEQ ID NO: 478202 - DNA, 15 bp, Homo sapiens
cttttttagctcatc

SEQ ID NO: 478203 - DNA, 15 bp, Homo sapiens
ttttttagctcatca

SEQ ID NO: 478204 - DNA, 15 bp, Homo sapiens
tttttagctcatcag

SEQ ID NO: 478205 - DNA, 15 bp, Homo sapiens
ttttagctcatcagc

SEQ ID NO: 478206 - DNA, 15 bp, Homo sapiens
tttagctcatcagct

SEQ ID NO: 478207 - DNA, 15 bp, Homo sapiens
ttagctcatcagcta

SEQ ID NO: 478208 - DNA, 15 bp, Homo sapiens
tagctcatcagctat

SEQ ID NO: 478209 - DNA, 15 bp, Homo sapiens
agctcatcagctatc

SEQ ID NO: 478210 - DNA, 15 bp, Homo sapiens
gctcatcagctatca

SEQ ID NO: 478211 - DNA, 15 bp, Homo sapiens
ctcatcagctatcat

SEQ ID NO: 478212 - DNA, 15 bp, Homo sapiens
tcatcagctatcatt

SEQ ID NO: 478213 - DNA, 15 bp, Homo sapiens
catcagctatcatta

SEQ ID NO: 478214 - DNA, 15 bp, Homo sapiens
atcagctatcattag

SEQ ID NO: 478215 - DNA, 15 bp, Homo sapiens
tcagctatcattagt

SEQ ID NO: 478216 - DNA, 15 bp, Homo sapiens
cagctatcattagtg

SEQ ID NO: 478217 - DNA, 15 bp, Homo sapiens
agctatcattagtgt

SEQ ID NO: 478218 - DNA, 15 bp, Homo sapiens
gctatcattagtgtt

SEQ ID NO: 478219 - DNA, 15 bp, Homo sapiens
ctatcattagtgtta

SEQ ID NO: 478220 - DNA, 15 bp, Homo sapiens
tatcattagtgttag

SEQ ID NO: 478221 - DNA, 15 bp, Homo sapiens
atcattagtgttagt

SEQ ID NO: 478222 - DNA, 15 bp, Homo sapiens
tcattagtgttagtg

SEQ ID NO: 478223 - DNA, 15 bp, Homo sapiens
cattagtgttagtgt

SEQ ID NO: 478224 - DNA, 15 bp, Homo sapiens
attagtgttagtgta

SEQ ID NO: 478225 - DNA, 15 bp, Homo sapiens
ttagtgttagtgtat

SEQ ID NO: 478226 - DNA, 15 bp, Homo sapiens
tagtgttagtgtatt

SEQ ID NO: 478227 - DNA, 15 bp, Homo sapiens
agtgttagtgtattt

SEQ ID NO: 478228 - DNA, 15 bp, Homo sapiens
gtgttagtgtattta

SEQ ID NO: 478229 - DNA, 15 bp, Homo sapiens
tgttagtgtatttaa

SEQ ID NO: 478230 - DNA, 15 bp, Homo sapiens
gttagtgtatttaat

SEQ ID NO: 478231 - DNA, 15 bp, Homo sapiens
ttagtgtatttaatg

SEQ ID NO: 478232 - DNA, 15 bp, Homo sapiens
tagtgtatttaatgt

SEQ ID NO: 478233 - DNA, 15 bp, Homo sapiens
agtgtatttaatgtg

SEQ ID NO: 478234 - DNA, 15 bp, Homo sapiens
gtgtatttaatgtgt

SEQ ID NO: 478235 - DNA, 15 bp, Homo sapiens
tgtatttaatgtgtg

SEQ ID NO: 478236 - DNA, 15 bp, Homo sapiens
gtatttaatgtgtgg

SEQ ID NO: 478237 - DNA, 15 bp, Homo sapiens
tatttaatgtgtggc

SEQ ID NO: 478238 - DNA, 15 bp, Homo sapiens
atttaatgtgtggcc

SEQ ID NO: 478239 - DNA, 15 bp, Homo sapiens
tttaatgtgtggccc

SEQ ID NO: 478240 - DNA, 15 bp, Homo sapiens
ttaatgtgtggccca

SEQ ID NO: 478241 - DNA, 15 bp, Homo sapiens
taatgtgtggcccaa

SEQ ID NO: 478242 - DNA, 15 bp, Homo sapiens
aatgtgtggcccaag

SEQ ID NO: 478243 - DNA, 15 bp, Homo sapiens
atgtgtggcccaaga

SEQ ID NO: 478244 - DNA, 15 bp, Homo sapiens
tgtgtggcccaagaa

SEQ ID NO: 478245 - DNA, 15 bp, Homo sapiens
gtgtggcccaagaaa

SEQ ID NO: 478246 - DNA, 15 bp, Homo sapiens
tgtggcccaagaaaa

SEQ ID NO: 478247 - DNA, 15 bp, Homo sapiens
gtggcccaagaaaat

SEQ ID NO: 478248 - DNA, 15 bp, Homo sapiens
tggcccaagaaaatt

SEQ ID NO: 478249 - DNA, 15 bp, Homo sapiens
ggcccaagaaaattc

SEQ ID NO: 478250 - DNA, 15 bp, Homo sapiens
gcccaagaaaattct

SEQ ID NO: 478251 - DNA, 15 bp, Homo sapiens
cccaagaaaattctt

SEQ ID NO: 478252 - DNA, 15 bp, Homo sapiens
ccaagaaaattctta

SEQ ID NO: 478253 - DNA, 15 bp, Homo sapiens
caagaaaattcttat

SEQ ID NO: 478254 - DNA, 15 bp, Homo sapiens
aagaaaattcttatt

SEQ ID NO: 478255 - DNA, 15 bp, Homo sapiens
agaaaattcttattc

SEQ ID NO: 478256 - DNA, 15 bp, Homo sapiens
gaaaattcttattct

SEQ ID NO: 478257 - DNA, 15 bp, Homo sapiens
aaaattcttattctt

SEQ ID NO: 478258 - DNA, 15 bp, Homo sapiens
aaattcttattcttt

SEQ ID NO: 478259 - DNA, 15 bp, Homo sapiens
aattcttattctttc

SEQ ID NO: 478260 - DNA, 15 bp, Homo sapiens
attcttattctttca

SEQ ID NO: 478261 - DNA, 15 bp, Homo sapiens
ttcttattctttcaa

SEQ ID NO: 478262 - DNA, 15 bp, Homo sapiens
tcttattctttcaat

SEQ ID NO: 478263 - DNA, 15 bp, Homo sapiens
cttattctttcaatg

SEQ ID NO: 478264 - DNA, 15 bp, Homo sapiens
ttattctttcaatgt

SEQ ID NO: 478265 - DNA, 15 bp, Homo sapiens
tattctttcaatgtg

SEQ ID NO: 478266 - DNA, 15 bp, Homo sapiens
attctttcaatgtgg

SEQ ID NO: 478267 - DNA, 15 bp, Homo sapiens
ttctttcaatgtggt

SEQ ID NO: 478268 - DNA, 15 bp, Homo sapiens
tctttcaatgtggtt

SEQ ID NO: 478269 - DNA, 15 bp, Homo sapiens
ctttcaatgtggttc

SEQ ID NO: 478270 - DNA, 15 bp, Homo sapiens
tttcaatgtggttcc

SEQ ID NO: 478271 - DNA, 15 bp, Homo sapiens
ttcaatgtggttcct

SEQ ID NO: 478272 - DNA, 15 bp, Homo sapiens
tcaatgtggttcctg

SEQ ID NO: 478273 - DNA, 15 bp, Homo sapiens
caatgtggttcctgg

SEQ ID NO: 478274 - DNA, 15 bp, Homo sapiens
aatgtggttcctgga

SEQ ID NO: 478275 - DNA, 15 bp, Homo sapiens
atgtggttcctggaa

SEQ ID NO: 478276 - DNA, 15 bp, Homo sapiens
tgtggttcctggaag

SEQ ID NO: 478277 - DNA, 15 bp, Homo sapiens
gtggttcctggaagc

SEQ ID NO: 478278 - DNA, 15 bp, Homo sapiens
tggttcctggaagcc

SEQ ID NO: 478279 - DNA, 15 bp, Homo sapiens
ggttcctggaagcca

SEQ ID NO: 478280 - DNA, 15 bp, Homo sapiens
gttcctggaagccaa

SEQ ID NO: 478281 - DNA, 15 bp, Homo sapiens
ttcctggaagccaaa

SEQ ID NO: 478282 - DNA, 15 bp, Homo sapiens
tcctggaagccaaaa

SEQ ID NO: 478283 - DNA, 15 bp, Homo sapiens
cctggaagccaaaag

SEQ ID NO: 478284 - DNA, 15 bp, Homo sapiens
ctggaagccaaaaga

SEQ ID NO: 478285 - DNA, 15 bp, Homo sapiens
tggaagccaaaagat

SEQ ID NO: 478286 - DNA, 15 bp, Homo sapiens
ggaagccaaaagatt

SEQ ID NO: 478287 - DNA, 15 bp, Homo sapiens
gaagccaaaagattg

SEQ ID NO: 478288 - DNA, 15 bp, Homo sapiens
aagccaaaagattga

SEQ ID NO: 478289 - DNA, 15 bp, Homo sapiens
agccaaaagattgaa

SEQ ID NO: 478290 - DNA, 15 bp, Homo sapiens
gccaaaagattgaat

SEQ ID NO: 478291 - DNA, 15 bp, Homo sapiens
ccaaaagattgaata

SEQ ID NO: 478292 - DNA, 15 bp, Homo sapiens
caaaagattgaatac

SEQ ID NO: 478293 - DNA, 15 bp, Homo sapiens
aaaagattgaatact

SEQ ID NO: 478294 - DNA, 15 bp, Homo sapiens
aaagattgaatactc

SEQ ID NO: 478295 - DNA, 15 bp, Homo sapiens
aagattgaatactcc

SEQ ID NO: 478296 - DNA, 15 bp, Homo sapiens
agattgaatactcct

SEQ ID NO: 478297 - DNA, 15 bp, Homo sapiens
gattgaatactcctg

SEQ ID NO: 478298 - DNA, 15 bp, Homo sapiens
attgaatactcctga

SEQ ID NO: 478299 - DNA, 15 bp, Homo sapiens
ttgaatactcctgat

SEQ ID NO: 478300 - DNA, 15 bp, Homo sapiens
tgaatactcctgatt

SEQ ID NO: 478301 - DNA, 15 bp, Homo sapiens
gaatactcctgattc

SEQ ID NO: 478302 - DNA, 15 bp, Homo sapiens
aatactcctgattca

SEQ ID NO: 478303 - DNA, 15 bp, Homo sapiens
atactcctgattcat

SEQ ID NO: 478304 - DNA, 15 bp, Homo sapiens
tactcctgattcatt

SEQ ID NO: 478305 - DNA, 15 bp, Homo sapiens
actcctgattcatta

SEQ ID NO: 478306 - DNA, 15 bp, Homo sapiens
ctcctgattcattat

SEQ ID NO: 478307 - DNA, 15 bp, Homo sapiens
tcctgattcattatc

SEQ ID NO: 478308 - DNA, 15 bp, Homo sapiens
cctgattcattatct

SEQ ID NO: 478309 - DNA, 15 bp, Homo sapiens
ctgattcattatctc

SEQ ID NO: 478310 - DNA, 15 bp, Homo sapiens
tgattcattatctct

SEQ ID NO: 478311 - DNA, 15 bp, Homo sapiens
gattcattatctctg

SEQ ID NO: 478312 - DNA, 15 bp, Homo sapiens
attcattatctctgt

SEQ ID NO: 478313 - DNA, 15 bp, Homo sapiens
ttcattatctctgtc

SEQ ID NO: 478314 - DNA, 15 bp, Homo sapiens
tcattatctctgtca

SEQ ID NO: 478315 - DNA, 15 bp, Homo sapiens
cattatctctgtcag

SEQ ID NO: 478316 - DNA, 15 bp, Homo sapiens
attatctctgtcagg

SEQ ID NO: 478317 - DNA, 15 bp, Homo sapiens
ttatctctgtcaggt

SEQ ID NO: 478318 - DNA, 15 bp, Homo sapiens
tatctctgtcaggtg

SEQ ID NO: 478319 - DNA, 15 bp, Homo sapiens
atctctgtcaggtgg

SEQ ID NO: 478320 - DNA, 15 bp, Homo sapiens
tctctgtcaggtggt

SEQ ID NO: 478321 - DNA, 15 bp, Homo sapiens
ctctgtcaggtggtg

SEQ ID NO: 478322 - DNA, 15 bp, Homo sapiens
tctgtcaggtggtgt

SEQ ID NO: 478323 - DNA, 15 bp, Homo sapiens
ctgtcaggtggtgta

SEQ ID NO: 478324 - DNA, 15 bp, Homo sapiens
tgtcaggtggtgtac

SEQ ID NO: 478325 - DNA, 15 bp, Homo sapiens
gtcaggtggtgtaca

SEQ ID NO: 478326 - DNA, 15 bp, Homo sapiens
tcaggtggtgtacaa

SEQ ID NO: 478327 - DNA, 15 bp, Homo sapiens
caggtggtgtacaaa

SEQ ID NO: 478328 - DNA, 15 bp, Homo sapiens
aggtggtgtacaaat

SEQ ID NO: 478329 - DNA, 15 bp, Homo sapiens
ggtggtgtacaaatg

SEQ ID NO: 478330 - DNA, 15 bp, Homo sapiens
gtggtgtacaaatgt

SEQ ID NO: 478331 - DNA, 15 bp, Homo sapiens
tggtgtacaaatgtg

SEQ ID NO: 478332 - DNA, 15 bp, Homo sapiens
ggtgtacaaatgtgt

SEQ ID NO: 478333 - DNA, 15 bp, Homo sapiens
gtgtacaaatgtgta

SEQ ID NO: 478334 - DNA, 15 bp, Homo sapiens
tgtacaaatgtgtat

SEQ ID NO: 478335 - DNA, 15 bp, Homo sapiens
gtacaaatgtgtatc

SEQ ID NO: 478336 - DNA, 15 bp, Homo sapiens
tacaaatgtgtatct

SEQ ID NO: 478337 - DNA, 15 bp, Homo sapiens
acaaatgtgtatctt

SEQ ID NO: 478338 - DNA, 15 bp, Homo sapiens
caaatgtgtatcttt

SEQ ID NO: 478339 - DNA, 15 bp, Homo sapiens
aaatgtgtatctttt

SEQ ID NO: 478340 - DNA, 15 bp, Homo sapiens
aatgtgtatcttttc

SEQ ID NO: 478341 - DNA, 15 bp, Homo sapiens
atgtgtatcttttcc

SEQ ID NO: 478342 - DNA, 15 bp, Homo sapiens
tgtgtatcttttccc

SEQ ID NO: 478343 - DNA, 15 bp, Homo sapiens
gtgtatcttttccca

SEQ ID NO: 478344 - DNA, 15 bp, Homo sapiens
tgtatcttttcccag

SEQ ID NO: 478345 - DNA, 15 bp, Homo sapiens
gtatcttttcccagt

SEQ ID NO: 478346 - DNA, 15 bp, Homo sapiens
tatcttttcccagtt

SEQ ID NO: 478347 - DNA, 15 bp, Homo sapiens
atcttttcccagttc

SEQ ID NO: 478348 - DNA, 15 bp, Homo sapiens
tcttttcccagttcc

SEQ ID NO: 478349 - DNA, 15 bp, Homo sapiens
cttttcccagttcca

SEQ ID NO: 478350 - DNA, 15 bp, Homo sapiens
ttttcccagttccac

SEQ ID NO: 478351 - DNA, 15 bp, Homo sapiens
tttcccagttccaca

SEQ ID NO: 478352 - DNA, 15 bp, Homo sapiens
ttcccagttccacat

SEQ ID NO: 478353 - DNA, 15 bp, Homo sapiens
tcccagttccacatt

SEQ ID NO: 478354 - DNA, 15 bp, Homo sapiens
cccagttccacattc

SEQ ID NO: 478355 - DNA, 15 bp, Homo sapiens
ccagttccacattca

SEQ ID NO: 478356 - DNA, 15 bp, Homo sapiens
cagttccacattcag

SEQ ID NO: 478357 - DNA, 15 bp, Homo sapiens
agttccacattcagt

SEQ ID NO: 478358 - DNA, 15 bp, Homo sapiens
gttccacattcagtg

SEQ ID NO: 478359 - DNA, 15 bp, Homo sapiens
ttccacattcagtga

SEQ ID NO: 478360 - DNA, 15 bp, Homo sapiens
tccacattcagtgaa

SEQ ID NO: 478361 - DNA, 15 bp, Homo sapiens
ccacattcagtgaag

SEQ ID NO: 478362 - DNA, 15 bp, Homo sapiens
cacattcagtgaagt

SEQ ID NO: 478363 - DNA, 15 bp, Homo sapiens
acattcagtgaagtc

SEQ ID NO: 478364 - DNA, 15 bp, Homo sapiens
cattcagtgaagtca

SEQ ID NO: 478365 - DNA, 15 bp, Homo sapiens
attcagtgaagtcat

SEQ ID NO: 478366 - DNA, 15 bp, Homo sapiens
ttcagtgaagtcatg

SEQ ID NO: 478367 - DNA, 15 bp, Homo sapiens
tcagtgaagtcatga

SEQ ID NO: 478368 - DNA, 15 bp, Homo sapiens
cagtgaagtcatgaa

SEQ ID NO: 478369 - DNA, 15 bp, Homo sapiens
agtgaagtcatgaac

SEQ ID NO: 478370 - DNA, 15 bp, Homo sapiens
gtgaagtcatgaact

SEQ ID NO: 478371 - DNA, 15 bp, Homo sapiens
tgaagtcatgaactt

SEQ ID NO: 478372 - DNA, 15 bp, Homo sapiens
gaagtcatgaacttg

SEQ ID NO: 478373 - DNA, 15 bp, Homo sapiens
aagtcatgaacttga

SEQ ID NO: 478374 - DNA, 15 bp, Homo sapiens
agtcatgaacttgaa

SEQ ID NO: 478375 - DNA, 15 bp, Homo sapiens
gtcatgaacttgaaa

SEQ ID NO: 478376 - DNA, 15 bp, Homo sapiens
tcatgaacttgaaat

SEQ ID NO: 478377 - DNA, 15 bp, Homo sapiens
catgaacttgaaatt

SEQ ID NO: 478378 - DNA, 15 bp, Homo sapiens
atgaacttgaaattg

SEQ ID NO: 478379 - DNA, 15 bp, Homo sapiens
tgaacttgaaattgg

SEQ ID NO: 478380 - DNA, 15 bp, Homo sapiens
gaacttgaaattggc

SEQ ID NO: 478381 - DNA, 15 bp, Homo sapiens
aacttgaaattggcc

SEQ ID NO: 478382 - DNA, 15 bp, Homo sapiens
acttgaaattggcca

SEQ ID NO: 478383 - DNA, 15 bp, Homo sapiens
cttgaaattggccat

SEQ ID NO: 478384 - DNA, 15 bp, Homo sapiens
ttgaaattggccatg

SEQ ID NO: 478385 - DNA, 15 bp, Homo sapiens
tgaaattggccatga

SEQ ID NO: 478386 - DNA, 15 bp, Homo sapiens
gaaattggccatgat

SEQ ID NO: 478387 - DNA, 15 bp, Homo sapiens
aaattggccatgatc

SEQ ID NO: 478388 - DNA, 15 bp, Homo sapiens
aattggccatgatca

SEQ ID NO: 478389 - DNA, 15 bp, Homo sapiens
attggccatgatcaa

SEQ ID NO: 478390 - DNA, 15 bp, Homo sapiens
ttggccatgatcaaa

SEQ ID NO: 478391 - DNA, 15 bp, Homo sapiens
tggccatgatcaaaa

SEQ ID NO: 478392 - DNA, 15 bp, Homo sapiens
ggccatgatcaaaaa

SEQ ID NO: 478393 - DNA, 15 bp, Homo sapiens
gccatgatcaaaaag

SEQ ID NO: 478394 - DNA, 15 bp, Homo sapiens
ccatgatcaaaaagt

SEQ ID NO: 478395 - DNA, 15 bp, Homo sapiens
catgatcaaaaagta

SEQ ID NO: 478396 - DNA, 15 bp, Homo sapiens
atgatcaaaaagtat

SEQ ID NO: 478397 - DNA, 15 bp, Homo sapiens
tgatcaaaaagtatt

SEQ ID NO: 478398 - DNA, 15 bp, Homo sapiens
gatcaaaaagtattt

SEQ ID NO: 478399 - DNA, 15 bp, Homo sapiens
atcaaaaagtattta

SEQ ID NO: 478400 - DNA, 15 bp, Homo sapiens
tcaaaaagtatttaa

SEQ ID NO: 478401 - DNA, 15 bp, Homo sapiens
caaaaagtatttaaa

SEQ ID NO: 478402 - DNA, 15 bp, Homo sapiens
aaaaagtatttaaat

SEQ ID NO: 478403 - DNA, 15 bp, Homo sapiens
aaaagtatttaaatc

SEQ ID NO: 478404 - DNA, 15 bp, Homo sapiens
aaagtatttaaatca

SEQ ID NO: 478405 - DNA, 15 bp, Homo sapiens
aagtatttaaatcac

SEQ ID NO: 478406 - DNA, 15 bp, Homo sapiens
agtatttaaatcaca

SEQ ID NO: 478407 - DNA, 15 bp, Homo sapiens
gtatttaaatcacag

SEQ ID NO: 478408 - DNA, 15 bp, Homo sapiens
tatttaaatcacaga

SEQ ID NO: 478409 - DNA, 15 bp, Homo sapiens
tttaaatcacagaag

SEQ ID NO: 478410 - DNA, 15 bp, Homo sapiens
ttaaatcacagaagt

SEQ ID NO: 478411 - DNA, 15 bp, Homo sapiens
taaatcacagaagtt

SEQ ID NO: 478412 - DNA, 15 bp, Homo sapiens
aaatcacagaagttg

SEQ ID NO: 478413 - DNA, 15 bp, Homo sapiens
aatcacagaagttgc

SEQ ID NO: 478414 - DNA, 15 bp, Homo sapiens
atcacagaagttgca

SEQ ID NO: 478415 - DNA, 15 bp, Homo sapiens
tcacagaagttgcaa

SEQ ID NO: 478416 - DNA, 15 bp, Homo sapiens
cacagaagttgcaaa

SEQ ID NO: 478417 - DNA, 15 bp, Homo sapiens
acagaagttgcaaat

SEQ ID NO: 478418 - DNA, 15 bp, Homo sapiens
cagaagttgcaaatg

SEQ ID NO: 478419 - DNA, 15 bp, Homo sapiens
agaagttgcaaatgc

SEQ ID NO: 478420 - DNA, 15 bp, Homo sapiens
gaagttgcaaatgcc

SEQ ID NO: 478421 - DNA, 15 bp, Homo sapiens
aagttgcaaatgcca

SEQ ID NO: 478422 - DNA, 15 bp, Homo sapiens
agttgcaaatgccac

SEQ ID NO: 478423 - DNA, 15 bp, Homo sapiens
gttgcaaatgccaca

SEQ ID NO: 478424 - DNA, 15 bp, Homo sapiens
ttgcaaatgccacaa

SEQ ID NO: 478425 - DNA, 15 bp, Homo sapiens
tgcaaatgccacaaa

SEQ ID NO: 478426 - DNA, 15 bp, Homo sapiens
gcaaatgccacaaat

SEQ ID NO: 478427 - DNA, 15 bp, Homo sapiens
caaatgccacaaatc

SEQ ID NO: 478428 - DNA, 15 bp, Homo sapiens
aaatgccacaaatca

SEQ ID NO: 478429 - DNA, 15 bp, Homo sapiens
aatgccacaaatcaa

SEQ ID NO: 478430 - DNA, 15 bp, Homo sapiens
atgccacaaatcaag

SEQ ID NO: 478431 - DNA, 15 bp, Homo sapiens
tgccacaaatcaagg

SEQ ID NO: 478432 - DNA, 15 bp, Homo sapiens
gccacaaatcaaggt

SEQ ID NO: 478433 - DNA, 15 bp, Homo sapiens
ccacaaatcaaggtc

SEQ ID NO: 478434 - DNA, 15 bp, Homo sapiens
cacaaatcaaggtct

SEQ ID NO: 478435 - DNA, 15 bp, Homo sapiens
acaaatcaaggtctt

SEQ ID NO: 478436 - DNA, 15 bp, Homo sapiens
caaatcaaggtcttt

SEQ ID NO: 478437 - DNA, 15 bp, Homo sapiens
aaatcaaggtctttt

SEQ ID NO: 478438 - DNA, 15 bp, Homo sapiens
aatcaaggtcttttt

SEQ ID NO: 478439 - DNA, 15 bp, Homo sapiens
atcaaggtctttttc

SEQ ID NO: 478440 - DNA, 15 bp, Homo sapiens
tcaaggtctttttct

SEQ ID NO: 478441 - DNA, 15 bp, Homo sapiens
caaggtctttttctc

SEQ ID NO: 478442 - DNA, 15 bp, Homo sapiens
aaggtctttttctct

SEQ ID NO: 478443 - DNA, 15 bp, Homo sapiens
aggtctttttctctt

SEQ ID NO: 478444 - DNA, 15 bp, Homo sapiens
ggtctttttctcttg

SEQ ID NO: 478445 - DNA, 15 bp, Homo sapiens
gtctttttctcttgg

SEQ ID NO: 478446 - DNA, 15 bp, Homo sapiens
tctttttctcttgga

SEQ ID NO: 478447 - DNA, 15 bp, Homo sapiens
ctttttctcttggag

SEQ ID NO: 478448 - DNA, 15 bp, Homo sapiens
tttttctcttggaga

SEQ ID NO: 478449 - DNA, 15 bp, Homo sapiens
ttttctcttggagaa

SEQ ID NO: 478450 - DNA, 15 bp, Homo sapiens
tttctcttggagaac

SEQ ID NO: 478451 - DNA, 15 bp, Homo sapiens
ttctcttggagaacc

SEQ ID NO: 478452 - DNA, 15 bp, Homo sapiens
tctcttggagaacct

SEQ ID NO: 478453 - DNA, 15 bp, Homo sapiens
ctcttggagaacctg

SEQ ID NO: 478454 - DNA, 15 bp, Homo sapiens
tcttggagaacctgt

SEQ ID NO: 478455 - DNA, 15 bp, Homo sapiens
cttggagaacctgtt

SEQ ID NO: 478456 - DNA, 15 bp, Homo sapiens
ttggagaacctgtta

SEQ ID NO: 478457 - DNA, 15 bp, Homo sapiens
tggagaacctgttaa

SEQ ID NO: 478458 - DNA, 15 bp, Homo sapiens
ggagaacctgttaaa

SEQ ID NO: 478459 - DNA, 15 bp, Homo sapiens
gagaacctgttaaac

SEQ ID NO: 478460 - DNA, 15 bp, Homo sapiens
agaacctgttaaaca

SEQ ID NO: 478461 - DNA, 15 bp, Homo sapiens
gaacctgttaaacat

SEQ ID NO: 478462 - DNA, 15 bp, Homo sapiens
aacctgttaaacatt

SEQ ID NO: 478463 - DNA, 15 bp, Homo sapiens
acctgttaaacattt

SEQ ID NO: 478464 - DNA, 15 bp, Homo sapiens
cctgttaaacattta

SEQ ID NO: 478465 - DNA, 15 bp, Homo sapiens
ctgttaaacatttac

SEQ ID NO: 478466 - DNA, 15 bp, Homo sapiens
tgttaaacatttacc

SEQ ID NO: 478467 - DNA, 15 bp, Homo sapiens
gttaaacatttacca

SEQ ID NO: 478468 - DNA, 15 bp, Homo sapiens
ttaaacatttaccaa

SEQ ID NO: 478469 - DNA, 15 bp, Homo sapiens
taaacatttaccaac

SEQ ID NO: 478470 - DNA, 15 bp, Homo sapiens
aaacatttaccaact

SEQ ID NO: 478471 - DNA, 15 bp, Homo sapiens
aacatttaccaactc

SEQ ID NO: 478472 - DNA, 15 bp, Homo sapiens
acatttaccaactca

SEQ ID NO: 478473 - DNA, 15 bp, Homo sapiens
catttaccaactcac

SEQ ID NO: 478474 - DNA, 15 bp, Homo sapiens
atttaccaactcacg

SEQ ID NO: 478475 - DNA, 15 bp, Homo sapiens
tttaccaactcacga

SEQ ID NO: 478476 - DNA, 15 bp, Homo sapiens
ttaccaactcacgac

SEQ ID NO: 478477 - DNA, 15 bp, Homo sapiens
taccaactcacgacc

SEQ ID NO: 478478 - DNA, 15 bp, Homo sapiens
accaactcacgaccg

SEQ ID NO: 478479 - DNA, 15 bp, Homo sapiens
ccaactcacgaccgc

SEQ ID NO: 478480 - DNA, 15 bp, Homo sapiens
caactcacgaccgcc

SEQ ID NO: 478481 - DNA, 15 bp, Homo sapiens
aactcacgaccgcca

SEQ ID NO: 478482 - DNA, 15 bp, Homo sapiens
actcacgaccgccat

SEQ ID NO: 478483 - DNA, 15 bp, Homo sapiens
ctcacgaccgccatg

SEQ ID NO: 478484 - DNA, 15 bp, Homo sapiens
tcacgaccgccatgc

SEQ ID NO: 478485 - DNA, 15 bp, Homo sapiens
cacgaccgccatgca

SEQ ID NO: 478486 - DNA, 15 bp, Homo sapiens
acgaccgccatgcac

SEQ ID NO: 478487 - DNA, 15 bp, Homo sapiens
cgaccgccatgcacc

SEQ ID NO: 478488 - DNA, 15 bp, Homo sapiens
gaccgccatgcaccc

SEQ ID NO: 478489 - DNA, 15 bp, Homo sapiens
accgccatgcaccca

SEQ ID NO: 478490 - DNA, 15 bp, Homo sapiens
ccgccatgcacccaa

SEQ ID NO: 478491 - DNA, 15 bp, Homo sapiens
cgccatgcacccaat

SEQ ID NO: 478492 - DNA, 15 bp, Homo sapiens
gccatgcacccaata

SEQ ID NO: 478493 - DNA, 15 bp, Homo sapiens
ccatgcacccaatac

SEQ ID NO: 478494 - DNA, 15 bp, Homo sapiens
catgcacccaatact

SEQ ID NO: 478495 - DNA, 15 bp, Homo sapiens
atgcacccaatactg

SEQ ID NO: 478496 - DNA, 15 bp, Homo sapiens
tgcacccaatactgc

SEQ ID NO: 478497 - DNA, 15 bp, Homo sapiens
gcacccaatactgca

SEQ ID NO: 478498 - DNA, 15 bp, Homo sapiens
cacccaatactgcaa

SEQ ID NO: 478499 - DNA, 15 bp, Homo sapiens
acccaatactgcaat

SEQ ID NO: 478500 - DNA, 15 bp, Homo sapiens
cccaatactgcaata

SEQ ID NO: 478501 - DNA, 15 bp, Homo sapiens
ccaatactgcaatag

SEQ ID NO: 478502 - DNA, 15 bp, Homo sapiens
caatactgcaatagg

SEQ ID NO: 478503 - DNA, 15 bp, Homo sapiens
aatactgcaataggt

SEQ ID NO: 478504 - DNA, 15 bp, Homo sapiens
atactgcaataggtc

SEQ ID NO: 478505 - DNA, 15 bp, Homo sapiens
tactgcaataggtct

SEQ ID NO: 478506 - DNA, 15 bp, Homo sapiens
actgcaataggtcta

SEQ ID NO: 478507 - DNA, 15 bp, Homo sapiens
ctgcaataggtctat

SEQ ID NO: 478508 - DNA, 15 bp, Homo sapiens
tgcaataggtctata

SEQ ID NO: 478509 - DNA, 15 bp, Homo sapiens
gcaataggtctatag

SEQ ID NO: 478510 - DNA, 15 bp, Homo sapiens
caataggtctataga

SEQ ID NO: 478511 - DNA, 15 bp, Homo sapiens
aataggtctatagat

SEQ ID NO: 478512 - DNA, 15 bp, Homo sapiens
ataggtctatagatg

SEQ ID NO: 478513 - DNA, 15 bp, Homo sapiens
taggtctatagatgc

SEQ ID NO: 478514 - DNA, 15 bp, Homo sapiens
aggtctatagatgca

SEQ ID NO: 478515 - DNA, 15 bp, Homo sapiens
ggtctatagatgcag

SEQ ID NO: 478516 - DNA, 15 bp, Homo sapiens
gtctatagatgcaga

SEQ ID NO: 478517 - DNA, 15 bp, Homo sapiens
tctatagatgcagat

SEQ ID NO: 478518 - DNA, 15 bp, Homo sapiens
ctatagatgcagata

SEQ ID NO: 478519 - DNA, 15 bp, Homo sapiens
tatagatgcagatac

SEQ ID NO: 478520 - DNA, 15 bp, Homo sapiens
atagatgcagatact

SEQ ID NO: 478521 - DNA, 15 bp, Homo sapiens
tagatgcagatactg

SEQ ID NO: 478522 - DNA, 15 bp, Homo sapiens
agatgcagatactgt

SEQ ID NO: 478523 - DNA, 15 bp, Homo sapiens
gatgcagatactgtc

SEQ ID NO: 478524 - DNA, 15 bp, Homo sapiens
atgcagatactgtct

SEQ ID NO: 478525 - DNA, 15 bp, Homo sapiens
tgcagatactgtctc

SEQ ID NO: 478526 - DNA, 15 bp, Homo sapiens
gcagatactgtctcc

SEQ ID NO: 478527 - DNA, 15 bp, Homo sapiens
cagatactgtctcca

SEQ ID NO: 478528 - DNA, 15 bp, Homo sapiens
agatactgtctccat

SEQ ID NO: 478529 - DNA, 15 bp, Homo sapiens
gatactgtctccatg

SEQ ID NO: 478530 - DNA, 15 bp, Homo sapiens
atactgtctccatga

SEQ ID NO: 478531 - DNA, 15 bp, Homo sapiens
tactgtctccatgaa

SEQ ID NO: 478532 - DNA, 15 bp, Homo sapiens
actgtctccatgaat

SEQ ID NO: 478533 - DNA, 15 bp, Homo sapiens
ctgtctccatgaatc

SEQ ID NO: 478534 - DNA, 15 bp, Homo sapiens
tgtctccatgaatct

SEQ ID NO: 478535 - DNA, 15 bp, Homo sapiens
gtctccatgaatctt

SEQ ID NO: 478536 - DNA, 15 bp, Homo sapiens
tctccatgaatctta

SEQ ID NO: 478537 - DNA, 15 bp, Homo sapiens
ctccatgaatcttat

SEQ ID NO: 478538 - DNA, 15 bp, Homo sapiens
tccatgaatcttata

SEQ ID NO: 478539 - DNA, 15 bp, Homo sapiens
ccatgaatcttatag

SEQ ID NO: 478540 - DNA, 15 bp, Homo sapiens
catgaatcttatagg

SEQ ID NO: 478541 - DNA, 15 bp, Homo sapiens
atgaatcttataggc

SEQ ID NO: 478542 - DNA, 15 bp, Homo sapiens
tgaatcttataggct

SEQ ID NO: 478543 - DNA, 15 bp, Homo sapiens
gaatcttataggcta

SEQ ID NO: 478544 - DNA, 15 bp, Homo sapiens
aatcttataggctag

SEQ ID NO: 478545 - DNA, 15 bp, Homo sapiens
atcttataggctaga

SEQ ID NO: 478546 - DNA, 15 bp, Homo sapiens
tcttataggctagaa

SEQ ID NO: 478547 - DNA, 15 bp, Homo sapiens
cttataggctagaaa

SEQ ID NO: 478548 - DNA, 15 bp, Homo sapiens
ttataggctagaaag

SEQ ID NO: 478549 - DNA, 15 bp, Homo sapiens
tataggctagaaagg

SEQ ID NO: 478550 - DNA, 15 bp, Homo sapiens
ataggctagaaagga

SEQ ID NO: 478551 - DNA, 15 bp, Homo sapiens
taggctagaaaggaa

SEQ ID NO: 478552 - DNA, 15 bp, Homo sapiens
aggctagaaaggaaa

SEQ ID NO: 478553 - DNA, 15 bp, Homo sapiens
ggctagaaaggaaat

SEQ ID NO: 478554 - DNA, 15 bp, Homo sapiens
gctagaaaggaaata

SEQ ID NO: 478555 - DNA, 15 bp, Homo sapiens
ctagaaaggaaatag

SEQ ID NO: 478556 - DNA, 15 bp, Homo sapiens
tagaaaggaaataga

SEQ ID NO: 478557 - DNA, 15 bp, Homo sapiens
agaaaggaaatagat

SEQ ID NO: 478558 - DNA, 15 bp, Homo sapiens
gaaaggaaatagata

SEQ ID NO: 478559 - DNA, 15 bp, Homo sapiens
aaaggaaatagataa

SEQ ID NO: 478560 - DNA, 15 bp, Homo sapiens
aaggaaatagataag

SEQ ID NO: 478561 - DNA, 15 bp, Homo sapiens
aggaaatagataagt

SEQ ID NO: 478562 - DNA, 15 bp, Homo sapiens
ggaaatagataagta

SEQ ID NO: 478563 - DNA, 15 bp, Homo sapiens
gaaatagataagtag

SEQ ID NO: 478564 - DNA, 15 bp, Homo sapiens
aaatagataagtagt

SEQ ID NO: 478565 - DNA, 15 bp, Homo sapiens
aatagataagtagtc

SEQ ID NO: 478566 - DNA, 15 bp, Homo sapiens
atagataagtagtcc

SEQ ID NO: 478567 - DNA, 15 bp, Homo sapiens
tagataagtagtcct

SEQ ID NO: 478568 - DNA, 15 bp, Homo sapiens
agataagtagtccta

SEQ ID NO: 478569 - DNA, 15 bp, Homo sapiens
gataagtagtcctac

SEQ ID NO: 478570 - DNA, 15 bp, Homo sapiens
ataagtagtcctacc

SEQ ID NO: 478571 - DNA, 15 bp, Homo sapiens
taagtagtcctacca

SEQ ID NO: 478572 - DNA, 15 bp, Homo sapiens
aagtagtcctaccag

SEQ ID NO: 478573 - DNA, 15 bp, Homo sapiens
agtagtcctaccaga

SEQ ID NO: 478574 - DNA, 15 bp, Homo sapiens
gtagtcctaccagaa

SEQ ID NO: 478575 - DNA, 15 bp, Homo sapiens
tagtcctaccagaag

SEQ ID NO: 478576 - DNA, 15 bp, Homo sapiens
agtcctaccagaaga

SEQ ID NO: 478577 - DNA, 15 bp, Homo sapiens
gtcctaccagaagaa

SEQ ID NO: 478578 - DNA, 15 bp, Homo sapiens
tcctaccagaagaac

SEQ ID NO: 478579 - DNA, 15 bp, Homo sapiens
cctaccagaagaaca

SEQ ID NO: 478580 - DNA, 15 bp, Homo sapiens
ctaccagaagaacat

SEQ ID NO: 478581 - DNA, 15 bp, Homo sapiens
taccagaagaacatg

SEQ ID NO: 478582 - DNA, 15 bp, Homo sapiens
accagaagaacatga

SEQ ID NO: 478583 - DNA, 15 bp, Homo sapiens
ccagaagaacatgat

SEQ ID NO: 478584 - DNA, 15 bp, Homo sapiens
cagaagaacatgatg

SEQ ID NO: 478585 - DNA, 15 bp, Homo sapiens
agaagaacatgatga

SEQ ID NO: 478586 - DNA, 15 bp, Homo sapiens
gaagaacatgatgaa

SEQ ID NO: 478587 - DNA, 15 bp, Homo sapiens
aagaacatgatgaag

SEQ ID NO: 478588 - DNA, 15 bp, Homo sapiens
agaacatgatgaagg

SEQ ID NO: 478589 - DNA, 15 bp, Homo sapiens
gaacatgatgaaggc

SEQ ID NO: 478590 - DNA, 15 bp, Homo sapiens
aacatgatgaaggca

SEQ ID NO: 478591 - DNA, 15 bp, Homo sapiens
acatgatgaaggcat

SEQ ID NO: 478592 - DNA, 15 bp, Homo sapiens
catgatgaaggcatt

SEQ ID NO: 478593 - DNA, 15 bp, Homo sapiens
atgatgaaggcattt

SEQ ID NO: 478594 - DNA, 15 bp, Homo sapiens
tgatgaaggcatttg

SEQ ID NO: 478595 - DNA, 15 bp, Homo sapiens
gatgaaggcatttgt

SEQ ID NO: 478596 - DNA, 15 bp, Homo sapiens
atgaaggcatttgtg

SEQ ID NO: 478597 - DNA, 15 bp, Homo sapiens
tgaaggcatttgtgg

SEQ ID NO: 478598 - DNA, 15 bp, Homo sapiens
gaaggcatttgtggt

SEQ ID NO: 478599 - DNA, 15 bp, Homo sapiens
aaggcatttgtggta

SEQ ID NO: 478600 - DNA, 15 bp, Homo sapiens
aggcatttgtggtaa

SEQ ID NO: 478601 - DNA, 15 bp, Homo sapiens
ggcatttgtggtaaa

SEQ ID NO: 478602 - DNA, 15 bp, Homo sapiens
gcatttgtggtaaac

SEQ ID NO: 478603 - DNA, 15 bp, Homo sapiens
catttgtggtaaaca

SEQ ID NO: 478604 - DNA, 15 bp, Homo sapiens
atttgtggtaaacag

SEQ ID NO: 478605 - DNA, 15 bp, Homo sapiens
tttgtggtaaacaga

SEQ ID NO: 478606 - DNA, 15 bp, Homo sapiens
ttgtggtaaacagaa

SEQ ID NO: 478607 - DNA, 15 bp, Homo sapiens
tgtggtaaacagaat

SEQ ID NO: 478608 - DNA, 15 bp, Homo sapiens
gtggtaaacagaatg

SEQ ID NO: 478609 - DNA, 15 bp, Homo sapiens
tggtaaacagaatga

SEQ ID NO: 478610 - DNA, 15 bp, Homo sapiens
ggtaaacagaatgat

SEQ ID NO: 478611 - DNA, 15 bp, Homo sapiens
gtaaacagaatgatg

SEQ ID NO: 478612 - DNA, 15 bp, Homo sapiens
taaacagaatgatgg

SEQ ID NO: 478613 - DNA, 15 bp, Homo sapiens
aaacagaatgatggc

SEQ ID NO: 478614 - DNA, 15 bp, Homo sapiens
aacagaatgatggcc

SEQ ID NO: 478615 - DNA, 15 bp, Homo sapiens
acagaatgatggccc

SEQ ID NO: 478616 - DNA, 15 bp, Homo sapiens
cagaatgatggcccc

SEQ ID NO: 478617 - DNA, 15 bp, Homo sapiens
agaatgatggccccc

SEQ ID NO: 478618 - DNA, 15 bp, Homo sapiens
gaatgatggcccccc

SEQ ID NO: 478619 - DNA, 15 bp, Homo sapiens
aatgatggcccccca

SEQ ID NO: 478620 - DNA, 15 bp, Homo sapiens
atgatggccccccaa

SEQ ID NO: 478621 - DNA, 15 bp, Homo sapiens
tgatggccccccaaa

SEQ ID NO: 478622 - DNA, 15 bp, Homo sapiens
gatggccccccaaag

SEQ ID NO: 478623 - DNA, 15 bp, Homo sapiens
atggccccccaaaga

SEQ ID NO: 478624 - DNA, 15 bp, Homo sapiens
tggccccccaaagat

SEQ ID NO: 478625 - DNA, 15 bp, Homo sapiens
ggccccccaaagatg

SEQ ID NO: 478626 - DNA, 15 bp, Homo sapiens
gccccccaaagatgt

SEQ ID NO: 478627 - DNA, 15 bp, Homo sapiens
ccccccaaagatgtc

SEQ ID NO: 478628 - DNA, 15 bp, Homo sapiens
cccccaaagatgtcc

SEQ ID NO: 478629 - DNA, 15 bp, Homo sapiens
ccccaaagatgtcca

SEQ ID NO: 478630 - DNA, 15 bp, Homo sapiens
cccaaagatgtccac

SEQ ID NO: 478631 - DNA, 15 bp, Homo sapiens
ccaaagatgtccaca

SEQ ID NO: 478632 - DNA, 15 bp, Homo sapiens
caaagatgtccacat

SEQ ID NO: 478633 - DNA, 15 bp, Homo sapiens
aaagatgtccacatc

SEQ ID NO: 478634 - DNA, 15 bp, Homo sapiens
aagatgtccacatcc

SEQ ID NO: 478635 - DNA, 15 bp, Homo sapiens
agatgtccacatcct

SEQ ID NO: 478636 - DNA, 15 bp, Homo sapiens
gatgtccacatccta

SEQ ID NO: 478637 - DNA, 15 bp, Homo sapiens
atgtccacatcctaa

SEQ ID NO: 478638 - DNA, 15 bp, Homo sapiens
tgtccacatcctaat

SEQ ID NO: 478639 - DNA, 15 bp, Homo sapiens
gtccacatcctaatc

SEQ ID NO: 478640 - DNA, 15 bp, Homo sapiens
tccacatcctaatcc

SEQ ID NO: 478641 - DNA, 15 bp, Homo sapiens
ccacatcctaatccc

SEQ ID NO: 478642 - DNA, 15 bp, Homo sapiens
cacatcctaatccct

SEQ ID NO: 478643 - DNA, 15 bp, Homo sapiens
acatcctaatccctg

SEQ ID NO: 478644 - DNA, 15 bp, Homo sapiens
catcctaatccctga

SEQ ID NO: 478645 - DNA, 15 bp, Homo sapiens
atcctaatccctgaa

SEQ ID NO: 478646 - DNA, 15 bp, Homo sapiens
tcctaatccctgaag

SEQ ID NO: 478647 - DNA, 15 bp, Homo sapiens
cctaatccctgaagc

SEQ ID NO: 478648 - DNA, 15 bp, Homo sapiens
ctaatccctgaagcc

SEQ ID NO: 478649 - DNA, 15 bp, Homo sapiens
taatccctgaagcct

SEQ ID NO: 478650 - DNA, 15 bp, Homo sapiens
aatccctgaagccta

SEQ ID NO: 478651 - DNA, 15 bp, Homo sapiens
atccctgaagcctat

SEQ ID NO: 478652 - DNA, 15 bp, Homo sapiens
tccctgaagcctatg

SEQ ID NO: 478653 - DNA, 15 bp, Homo sapiens
ccctgaagcctatga

SEQ ID NO: 478654 - DNA, 15 bp, Homo sapiens
cctgaagcctatgaa

SEQ ID NO: 478655 - DNA, 15 bp, Homo sapiens
ctgaagcctatgaat

SEQ ID NO: 478656 - DNA, 15 bp, Homo sapiens
tgaagcctatgaata

SEQ ID NO: 478657 - DNA, 15 bp, Homo sapiens
gaagcctatgaatat

SEQ ID NO: 478658 - DNA, 15 bp, Homo sapiens
aagcctatgaatata

SEQ ID NO: 478659 - DNA, 15 bp, Homo sapiens
agcctatgaatatac

SEQ ID NO: 478660 - DNA, 15 bp, Homo sapiens
gcctatgaatatact

SEQ ID NO: 478661 - DNA, 15 bp, Homo sapiens
cctatgaatatacta

SEQ ID NO: 478662 - DNA, 15 bp, Homo sapiens
ctatgaatatactac

SEQ ID NO: 478663 - DNA, 15 bp, Homo sapiens
tatgaatatactact

SEQ ID NO: 478664 - DNA, 15 bp, Homo sapiens
atgaatatactactt

SEQ ID NO: 478665 - DNA, 15 bp, Homo sapiens
tgaatatactacttt

SEQ ID NO: 478666 - DNA, 15 bp, Homo sapiens
gaatatactacttta

SEQ ID NO: 478667 - DNA, 15 bp, Homo sapiens
aatatactactttac

SEQ ID NO: 478668 - DNA, 15 bp, Homo sapiens
atatactactttact

SEQ ID NO: 478669 - DNA, 15 bp, Homo sapiens
tatactactttactt

SEQ ID NO: 478670 - DNA, 15 bp, Homo sapiens
atactactttacttg

SEQ ID NO: 478671 - DNA, 15 bp, Homo sapiens
tactactttacttgg

SEQ ID NO: 478672 - DNA, 15 bp, Homo sapiens
actactttacttggc

SEQ ID NO: 478673 - DNA, 15 bp, Homo sapiens
ctactttacttggca

SEQ ID NO: 478674 - DNA, 15 bp, Homo sapiens
tactttacttggcaa

SEQ ID NO: 478675 - DNA, 15 bp, Homo sapiens
actttacttggcaaa

SEQ ID NO: 478676 - DNA, 15 bp, Homo sapiens
ctttacttggcaaaa

SEQ ID NO: 478677 - DNA, 15 bp, Homo sapiens
tttacttggcaaaag

SEQ ID NO: 478678 - DNA, 15 bp, Homo sapiens
ttacttggcaaaagg

SEQ ID NO: 478679 - DNA, 15 bp, Homo sapiens
tacttggcaaaaggg

SEQ ID NO: 478680 - DNA, 15 bp, Homo sapiens
acttggcaaaaggga

SEQ ID NO: 478681 - DNA, 15 bp, Homo sapiens
cttggcaaaagggac

SEQ ID NO: 478682 - DNA, 15 bp, Homo sapiens
ttggcaaaagggact

SEQ ID NO: 478683 - DNA, 15 bp, Homo sapiens
tggcaaaagggactt

SEQ ID NO: 478684 - DNA, 15 bp, Homo sapiens
ggcaaaagggacttt

SEQ ID NO: 478685 - DNA, 15 bp, Homo sapiens
gcaaaagggactttg

SEQ ID NO: 478686 - DNA, 15 bp, Homo sapiens
caaaagggactttgc

SEQ ID NO: 478687 - DNA, 15 bp, Homo sapiens
aaaagggactttgcc

SEQ ID NO: 478688 - DNA, 15 bp, Homo sapiens
aaagggactttgcca

SEQ ID NO: 478689 - DNA, 15 bp, Homo sapiens
aagggactttgccac

SEQ ID NO: 478690 - DNA, 15 bp, Homo sapiens
agggactttgccaca

SEQ ID NO: 478691 - DNA, 15 bp, Homo sapiens
gggactttgccacag

SEQ ID NO: 478692 - DNA, 15 bp, Homo sapiens
ggactttgccacagg

SEQ ID NO: 478693 - DNA, 15 bp, Homo sapiens
gactttgccacaggt

SEQ ID NO: 478694 - DNA, 15 bp, Homo sapiens
actttgccacaggtt

SEQ ID NO: 478695 - DNA, 15 bp, Homo sapiens
ctttgccacaggttt

SEQ ID NO: 478696 - DNA, 15 bp, Homo sapiens
tttgccacaggtttt

SEQ ID NO: 478697 - DNA, 15 bp, Homo sapiens
ttgccacaggttttt

SEQ ID NO: 478698 - DNA, 15 bp, Homo sapiens
tgccacaggttttta

SEQ ID NO: 478699 - DNA, 15 bp, Homo sapiens
gccacaggtttttaa

SEQ ID NO: 478700 - DNA, 15 bp, Homo sapiens
ccacaggtttttaat

SEQ ID NO: 478701 - DNA, 15 bp, Homo sapiens
cacaggtttttaatt

SEQ ID NO: 478702 - DNA, 15 bp, Homo sapiens
acaggtttttaatta

SEQ ID NO: 478703 - DNA, 15 bp, Homo sapiens
caggtttttaattaa

SEQ ID NO: 478704 - DNA, 15 bp, Homo sapiens
aggtttttaattaag

SEQ ID NO: 478705 - DNA, 15 bp, Homo sapiens
ggtttttaattaagg

SEQ ID NO: 478706 - DNA, 15 bp, Homo sapiens
gtttttaattaagga

SEQ ID NO: 478707 - DNA, 15 bp, Homo sapiens
tttttaattaaggac

SEQ ID NO: 478708 - DNA, 15 bp, Homo sapiens
ttttaattaaggacc

SEQ ID NO: 478709 - DNA, 15 bp, Homo sapiens
tttaattaaggacct

SEQ ID NO: 478710 - DNA, 15 bp, Homo sapiens
ttaattaaggacctt

SEQ ID NO: 478711 - DNA, 15 bp, Homo sapiens
taattaaggaccttg

SEQ ID NO: 478712 - DNA, 15 bp, Homo sapiens
aattaaggaccttga

SEQ ID NO: 478713 - DNA, 15 bp, Homo sapiens
attaaggaccttgaa

SEQ ID NO: 478714 - DNA, 15 bp, Homo sapiens
ttaaggaccttgaaa

SEQ ID NO: 478715 - DNA, 15 bp, Homo sapiens
taaggaccttgaaat

SEQ ID NO: 478716 - DNA, 15 bp, Homo sapiens
aaggaccttgaaata

SEQ ID NO: 478717 - DNA, 15 bp, Homo sapiens
aggaccttgaaatag

SEQ ID NO: 478718 - DNA, 15 bp, Homo sapiens
ggaccttgaaataga

SEQ ID NO: 478719 - DNA, 15 bp, Homo sapiens
gaccttgaaatagag

SEQ ID NO: 478720 - DNA, 15 bp, Homo sapiens
accttgaaatagaga

SEQ ID NO: 478721 - DNA, 15 bp, Homo sapiens
ccttgaaatagagag

SEQ ID NO: 478722 - DNA, 15 bp, Homo sapiens
cttgaaatagagaga

SEQ ID NO: 478723 - DNA, 15 bp, Homo sapiens
ttgaaatagagagat

SEQ ID NO: 478724 - DNA, 15 bp, Homo sapiens
tgaaatagagagatt

SEQ ID NO: 478725 - DNA, 15 bp, Homo sapiens
gaaatagagagatta

SEQ ID NO: 478726 - DNA, 15 bp, Homo sapiens
aaatagagagattat

SEQ ID NO: 478727 - DNA, 15 bp, Homo sapiens
aatagagagattatc

SEQ ID NO: 478728 - DNA, 15 bp, Homo sapiens
atagagagattatcc

SEQ ID NO: 478729 - DNA, 15 bp, Homo sapiens
tagagagattatcct

SEQ ID NO: 478730 - DNA, 15 bp, Homo sapiens
agagagattatcctg

SEQ ID NO: 478731 - DNA, 15 bp, Homo sapiens
gagagattatcctgg

SEQ ID NO: 478732 - DNA, 15 bp, Homo sapiens
agagattatcctgga

SEQ ID NO: 478733 - DNA, 15 bp, Homo sapiens
gagattatcctggat

SEQ ID NO: 478734 - DNA, 15 bp, Homo sapiens
agattatcctggata

SEQ ID NO: 478735 - DNA, 15 bp, Homo sapiens
gattatcctggataa

SEQ ID NO: 478736 - DNA, 15 bp, Homo sapiens
attatcctggataat

SEQ ID NO: 478737 - DNA, 15 bp, Homo sapiens
ttatcctggataatc

SEQ ID NO: 478738 - DNA, 15 bp, Homo sapiens
tatcctggataatcc

SEQ ID NO: 478739 - DNA, 15 bp, Homo sapiens
atcctggataatcca

SEQ ID NO: 478740 - DNA, 15 bp, Homo sapiens
tcctggataatccag

SEQ ID NO: 478741 - DNA, 15 bp, Homo sapiens
cctggataatccaga

SEQ ID NO: 478742 - DNA, 15 bp, Homo sapiens
ctggataatccagat

SEQ ID NO: 478743 - DNA, 15 bp, Homo sapiens
tggataatccagatg

SEQ ID NO: 478744 - DNA, 15 bp, Homo sapiens
ggataatccagatgg

SEQ ID NO: 478745 - DNA, 15 bp, Homo sapiens
gataatccagatggc

SEQ ID NO: 478746 - DNA, 15 bp, Homo sapiens
ataatccagatggcc

SEQ ID NO: 478747 - DNA, 15 bp, Homo sapiens
taatccagatggccc

SEQ ID NO: 478748 - DNA, 15 bp, Homo sapiens
aatccagatggcccc

SEQ ID NO: 478749 - DNA, 15 bp, Homo sapiens
atccagatggcccca

SEQ ID NO: 478750 - DNA, 15 bp, Homo sapiens
tccagatggccccag

SEQ ID NO: 478751 - DNA, 15 bp, Homo sapiens
ccagatggccccagt

SEQ ID NO: 478752 - DNA, 15 bp, Homo sapiens
cagatggccccagtg

SEQ ID NO: 478753 - DNA, 15 bp, Homo sapiens
agatggccccagtgt

SEQ ID NO: 478754 - DNA, 15 bp, Homo sapiens
gatggccccagtgta

SEQ ID NO: 478755 - DNA, 15 bp, Homo sapiens
atggccccagtgtaa

SEQ ID NO: 478756 - DNA, 15 bp, Homo sapiens
tggccccagtgtaat

SEQ ID NO: 478757 - DNA, 15 bp, Homo sapiens
ggccccagtgtaatc

SEQ ID NO: 478758 - DNA, 15 bp, Homo sapiens
gccccagtgtaatcc

SEQ ID NO: 478759 - DNA, 15 bp, Homo sapiens
ccccagtgtaatccc

SEQ ID NO: 478760 - DNA, 15 bp, Homo sapiens
cccagtgtaatccca

SEQ ID NO: 478761 - DNA, 15 bp, Homo sapiens
ccagtgtaatcccaa

SEQ ID NO: 478762 - DNA, 15 bp, Homo sapiens
cagtgtaatcccaag

SEQ ID NO: 478763 - DNA, 15 bp, Homo sapiens
agtgtaatcccaagg

SEQ ID NO: 478764 - DNA, 15 bp, Homo sapiens
gtgtaatcccaaggg

SEQ ID NO: 478765 - DNA, 15 bp, Homo sapiens
tgtaatcccaagggt

SEQ ID NO: 478766 - DNA, 15 bp, Homo sapiens
gtaatcccaagggtc

SEQ ID NO: 478767 - DNA, 15 bp, Homo sapiens
taatcccaagggtcc

SEQ ID NO: 478768 - DNA, 15 bp, Homo sapiens
aatcccaagggtcct

SEQ ID NO: 478769 - DNA, 15 bp, Homo sapiens
atcccaagggtcctc

SEQ ID NO: 478770 - DNA, 15 bp, Homo sapiens
tcccaagggtcctca

SEQ ID NO: 478771 - DNA, 15 bp, Homo sapiens
cccaagggtcctcat

SEQ ID NO: 478772 - DNA, 15 bp, Homo sapiens
ccaagggtcctcata

SEQ ID NO: 478773 - DNA, 15 bp, Homo sapiens
caagggtcctcataa

SEQ ID NO: 478774 - DNA, 15 bp, Homo sapiens
aagggtcctcataaa

SEQ ID NO: 478775 - DNA, 15 bp, Homo sapiens
agggtcctcataaag

SEQ ID NO: 478776 - DNA, 15 bp, Homo sapiens
gggtcctcataaagg

SEQ ID NO: 478777 - DNA, 15 bp, Homo sapiens
ggtcctcataaaggg

SEQ ID NO: 478778 - DNA, 15 bp, Homo sapiens
gtcctcataaagggt

SEQ ID NO: 478779 - DNA, 15 bp, Homo sapiens
tcctcataaagggta

SEQ ID NO: 478780 - DNA, 15 bp, Homo sapiens
cctcataaagggtag

SEQ ID NO: 478781 - DNA, 15 bp, Homo sapiens
ctcataaagggtagg

SEQ ID NO: 478782 - DNA, 15 bp, Homo sapiens
tcataaagggtagga

SEQ ID NO: 478783 - DNA, 15 bp, Homo sapiens
cataaagggtaggaa

SEQ ID NO: 478784 - DNA, 15 bp, Homo sapiens
ataaagggtaggaag

SEQ ID NO: 478785 - DNA, 15 bp, Homo sapiens
taaagggtaggaagg

SEQ ID NO: 478786 - DNA, 15 bp, Homo sapiens
aaagggtaggaagga

SEQ ID NO: 478787 - DNA, 15 bp, Homo sapiens
aagggtaggaaggag

SEQ ID NO: 478788 - DNA, 15 bp, Homo sapiens
agggtaggaaggaga

SEQ ID NO: 478789 - DNA, 15 bp, Homo sapiens
gggtaggaaggagag

SEQ ID NO: 478790 - DNA, 15 bp, Homo sapiens
ggtaggaaggagagc

SEQ ID NO: 478791 - DNA, 15 bp, Homo sapiens
gtaggaaggagagcc

SEQ ID NO: 478792 - DNA, 15 bp, Homo sapiens
taggaaggagagcca

SEQ ID NO: 478793 - DNA, 15 bp, Homo sapiens
aggaaggagagccag

SEQ ID NO: 478794 - DNA, 15 bp, Homo sapiens
ggaaggagagccaga

SEQ ID NO: 478795 - DNA, 15 bp, Homo sapiens
gaaggagagccagag

SEQ ID NO: 478796 - DNA, 15 bp, Homo sapiens
aaggagagccagagt

SEQ ID NO: 478797 - DNA, 15 bp, Homo sapiens
aggagagccagagtc

SEQ ID NO: 478798 - DNA, 15 bp, Homo sapiens
ggagagccagagtca

SEQ ID NO: 478799 - DNA, 15 bp, Homo sapiens
gagagccagagtcag

SEQ ID NO: 478800 - DNA, 15 bp, Homo sapiens
agagccagagtcaga

SEQ ID NO: 478801 - DNA, 15 bp, Homo sapiens
gagccagagtcagag

SEQ ID NO: 478802 - DNA, 15 bp, Homo sapiens
agccagagtcagaga

SEQ ID NO: 478803 - DNA, 15 bp, Homo sapiens
gccagagtcagagaa

SEQ ID NO: 478804 - DNA, 15 bp, Homo sapiens
ccagagtcagagaag

SEQ ID NO: 478805 - DNA, 15 bp, Homo sapiens
cagagtcagagaagg

SEQ ID NO: 478806 - DNA, 15 bp, Homo sapiens
agagtcagagaagga

SEQ ID NO: 478807 - DNA, 15 bp, Homo sapiens
gagtcagagaaggag

SEQ ID NO: 478808 - DNA, 15 bp, Homo sapiens
agtcagagaaggaga

SEQ ID NO: 478809 - DNA, 15 bp, Homo sapiens
gtcagagaaggagac

SEQ ID NO: 478810 - DNA, 15 bp, Homo sapiens
tcagagaaggagacg

SEQ ID NO: 478811 - DNA, 15 bp, Homo sapiens
cagagaaggagacgt

SEQ ID NO: 478812 - DNA, 15 bp, Homo sapiens
agagaaggagacgta

SEQ ID NO: 478813 - DNA, 15 bp, Homo sapiens
gagaaggagacgtag

SEQ ID NO: 478814 - DNA, 15 bp, Homo sapiens
agaaggagacgtagc

SEQ ID NO: 478815 - DNA, 15 bp, Homo sapiens
gaaggagacgtagca

SEQ ID NO: 478816 - DNA, 15 bp, Homo sapiens
aaggagacgtagcaa

SEQ ID NO: 478817 - DNA, 15 bp, Homo sapiens
aggagacgtagcaat

SEQ ID NO: 478818 - DNA, 15 bp, Homo sapiens
ggagacgtagcaatg

SEQ ID NO: 478819 - DNA, 15 bp, Homo sapiens
gagacgtagcaatgg

SEQ ID NO: 478820 - DNA, 15 bp, Homo sapiens
agacgtagcaatgga

SEQ ID NO: 478821 - DNA, 15 bp, Homo sapiens
gacgtagcaatggag

SEQ ID NO: 478822 - DNA, 15 bp, Homo sapiens
acgtagcaatggagg

SEQ ID NO: 478823 - DNA, 15 bp, Homo sapiens
cgtagcaatggaggc

SEQ ID NO: 478824 - DNA, 15 bp, Homo sapiens
gtagcaatggaggca

SEQ ID NO: 478825 - DNA, 15 bp, Homo sapiens
tagcaatggaggcag

SEQ ID NO: 478826 - DNA, 15 bp, Homo sapiens
agcaatggaggcaga

SEQ ID NO: 478827 - DNA, 15 bp, Homo sapiens
gcaatggaggcagag

SEQ ID NO: 478828 - DNA, 15 bp, Homo sapiens
caatggaggcagagg

SEQ ID NO: 478829 - DNA, 15 bp, Homo sapiens
aatggaggcagaggt

SEQ ID NO: 478830 - DNA, 15 bp, Homo sapiens
atggaggcagaggtc

SEQ ID NO: 478831 - DNA, 15 bp, Homo sapiens
tggaggcagaggtca

SEQ ID NO: 478832 - DNA, 15 bp, Homo sapiens
ggaggcagaggtcag

SEQ ID NO: 478833 - DNA, 15 bp, Homo sapiens
gaggcagaggtcaga

SEQ ID NO: 478834 - DNA, 15 bp, Homo sapiens
aggcagaggtcagag

SEQ ID NO: 478835 - DNA, 15 bp, Homo sapiens
ggcagaggtcagaga

SEQ ID NO: 478836 - DNA, 15 bp, Homo sapiens
gcagaggtcagagag

SEQ ID NO: 478837 - DNA, 15 bp, Homo sapiens
agaggtcagagagag

SEQ ID NO: 478838 - DNA, 15 bp, Homo sapiens
gaggtcagagagaga

SEQ ID NO: 478839 - DNA, 15 bp, Homo sapiens
aggtcagagagagat

SEQ ID NO: 478840 - DNA, 15 bp, Homo sapiens
ggtcagagagagatc

SEQ ID NO: 478841 - DNA, 15 bp, Homo sapiens
gtcagagagagatct

SEQ ID NO: 478842 - DNA, 15 bp, Homo sapiens
cagagagagatctgc

SEQ ID NO: 478843 - DNA, 15 bp, Homo sapiens
agagagagatctgca

SEQ ID NO: 478844 - DNA, 15 bp, Homo sapiens
gagagagatctgcag

SEQ ID NO: 478845 - DNA, 15 bp, Homo sapiens
agagagatctgcaga

SEQ ID NO: 478846 - DNA, 15 bp, Homo sapiens
gagagatctgcagat

SEQ ID NO: 478847 - DNA, 15 bp, Homo sapiens
agagatctgcagatg

SEQ ID NO: 478848 - DNA, 15 bp, Homo sapiens
gagatctgcagatgc

SEQ ID NO: 478849 - DNA, 15 bp, Homo sapiens
agatctgcagatgct

SEQ ID NO: 478850 - DNA, 15 bp, Homo sapiens
gatctgcagatgctg

SEQ ID NO: 478851 - DNA, 15 bp, Homo sapiens
atctgcagatgctgc

SEQ ID NO: 478852 - DNA, 15 bp, Homo sapiens
tctgcagatgctgct

SEQ ID NO: 478853 - DNA, 15 bp, Homo sapiens
ctgcagatgctgctg

SEQ ID NO: 478854 - DNA, 15 bp, Homo sapiens
tgcagatgctgctgt

SEQ ID NO: 478855 - DNA, 15 bp, Homo sapiens
gcagatgctgctgtg

SEQ ID NO: 478856 - DNA, 15 bp, Homo sapiens
cagatgctgctgtgt

SEQ ID NO: 478857 - DNA, 15 bp, Homo sapiens
agatgctgctgtgtt

SEQ ID NO: 478858 - DNA, 15 bp, Homo sapiens
gatgctgctgtgttg

SEQ ID NO: 478859 - DNA, 15 bp, Homo sapiens
atgctgctgtgttgg

SEQ ID NO: 478860 - DNA, 15 bp, Homo sapiens
tgctgctgtgttggc

SEQ ID NO: 478861 - DNA, 15 bp, Homo sapiens
gctgctgtgttggct

SEQ ID NO: 478862 - DNA, 15 bp, Homo sapiens
ctgctgtgttggctt

SEQ ID NO: 478863 - DNA, 15 bp, Homo sapiens
tgctgtgttggcttt

SEQ ID NO: 478864 - DNA, 15 bp, Homo sapiens
gctgtgttggctttg

SEQ ID NO: 478865 - DNA, 15 bp, Homo sapiens
ctgtgttggctttga

SEQ ID NO: 478866 - DNA, 15 bp, Homo sapiens
tgtgttggctttgaa

SEQ ID NO: 478867 - DNA, 15 bp, Homo sapiens
gtgttggctttgaaa

SEQ ID NO: 478868 - DNA, 15 bp, Homo sapiens
tgttggctttgaaaa

SEQ ID NO: 478869 - DNA, 15 bp, Homo sapiens
gttggctttgaaaat

SEQ ID NO: 478870 - DNA, 15 bp, Homo sapiens
ttggctttgaaaatg

SEQ ID NO: 478871 - DNA, 15 bp, Homo sapiens
tggctttgaaaatga

SEQ ID NO: 478872 - DNA, 15 bp, Homo sapiens
ggctttgaaaatgag

SEQ ID NO: 478873 - DNA, 15 bp, Homo sapiens
gctttgaaaatgagg

SEQ ID NO: 478874 - DNA, 15 bp, Homo sapiens
ctttgaaaatgagga

SEQ ID NO: 478875 - DNA, 15 bp, Homo sapiens
tgaaaatgaggaatg

SEQ ID NO: 478876 - DNA, 15 bp, Homo sapiens
gaaaatgaggaatgc

SEQ ID NO: 478877 - DNA, 15 bp, Homo sapiens
aaaatgaggaatgca

SEQ ID NO: 478878 - DNA, 15 bp, Homo sapiens
aaatgaggaatgcag

SEQ ID NO: 478879 - DNA, 15 bp, Homo sapiens
aatgaggaatgcagg

SEQ ID NO: 478880 - DNA, 15 bp, Homo sapiens
atgaggaatgcaggt

SEQ ID NO: 478881 - DNA, 15 bp, Homo sapiens
tgaggaatgcaggtg

SEQ ID NO: 478882 - DNA, 15 bp, Homo sapiens
gaggaatgcaggtga

SEQ ID NO: 478883 - DNA, 15 bp, Homo sapiens
aggaatgcaggtgac

SEQ ID NO: 478884 - DNA, 15 bp, Homo sapiens
ggaatgcaggtgacc

SEQ ID NO: 478885 - DNA, 15 bp, Homo sapiens
gaatgcaggtgacct

SEQ ID NO: 478886 - DNA, 15 bp, Homo sapiens
aatgcaggtgacctc

SEQ ID NO: 478887 - DNA, 15 bp, Homo sapiens
atgcaggtgacctca

SEQ ID NO: 478888 - DNA, 15 bp, Homo sapiens
tgcaggtgacctcaa

SEQ ID NO: 478889 - DNA, 15 bp, Homo sapiens
gcaggtgacctcaag

SEQ ID NO: 478890 - DNA, 15 bp, Homo sapiens
caggtgacctcaagg

SEQ ID NO: 478891 - DNA, 15 bp, Homo sapiens
aggtgacctcaaggt

SEQ ID NO: 478892 - DNA, 15 bp, Homo sapiens
ggtgacctcaaggtg

SEQ ID NO: 478893 - DNA, 15 bp, Homo sapiens
gtgacctcaaggtgc

SEQ ID NO: 478894 - DNA, 15 bp, Homo sapiens
tgacctcaaggtgct

SEQ ID NO: 478895 - DNA, 15 bp, Homo sapiens
gacctcaaggtgcta

SEQ ID NO: 478896 - DNA, 15 bp, Homo sapiens
acctcaaggtgctag

SEQ ID NO: 478897 - DNA, 15 bp, Homo sapiens
cctcaaggtgctaga

SEQ ID NO: 478898 - DNA, 15 bp, Homo sapiens
ctcaaggtgctagat

SEQ ID NO: 478899 - DNA, 15 bp, Homo sapiens
tcaaggtgctagatg

SEQ ID NO: 478900 - DNA, 15 bp, Homo sapiens
caaggtgctagatga

SEQ ID NO: 478901 - DNA, 15 bp, Homo sapiens
aaggtgctagatgat

SEQ ID NO: 478902 - DNA, 15 bp, Homo sapiens
aggtgctagatgatg

SEQ ID NO: 478903 - DNA, 15 bp, Homo sapiens
ggtgctagatgatgc

SEQ ID NO: 478904 - DNA, 15 bp, Homo sapiens
gtgctagatgatgca

SEQ ID NO: 478905 - DNA, 15 bp, Homo sapiens
tgctagatgatgcaa

SEQ ID NO: 478906 - DNA, 15 bp, Homo sapiens
gctagatgatgcaag

SEQ ID NO: 478907 - DNA, 15 bp, Homo sapiens
ctagatgatgcaagg

SEQ ID NO: 478908 - DNA, 15 bp, Homo sapiens
tagatgatgcaagga

SEQ ID NO: 478909 - DNA, 15 bp, Homo sapiens
agatgatgcaaggaa

SEQ ID NO: 478910 - DNA, 15 bp, Homo sapiens
gatgatgcaaggaaa

SEQ ID NO: 478911 - DNA, 15 bp, Homo sapiens
atgatgcaaggaaac

SEQ ID NO: 478912 - DNA, 15 bp, Homo sapiens
tgatgcaaggaaaca

SEQ ID NO: 478913 - DNA, 15 bp, Homo sapiens
gatgcaaggaaacaa

SEQ ID NO: 478914 - DNA, 15 bp, Homo sapiens
atgcaaggaaacaaa

SEQ ID NO: 478915 - DNA, 15 bp, Homo sapiens
tgcaaggaaacaaat

SEQ ID NO: 478916 - DNA, 15 bp, Homo sapiens
gcaaggaaacaaata

SEQ ID NO: 478917 - DNA, 15 bp, Homo sapiens
caaggaaacaaataa

SEQ ID NO: 478918 - DNA, 15 bp, Homo sapiens
aaggaaacaaataat

SEQ ID NO: 478919 - DNA, 15 bp, Homo sapiens
aggaaacaaataatc

SEQ ID NO: 478920 - DNA, 15 bp, Homo sapiens
ggaaacaaataatct

SEQ ID NO: 478921 - DNA, 15 bp, Homo sapiens
gaaacaaataatctc

SEQ ID NO: 478922 - DNA, 15 bp, Homo sapiens
aaacaaataatctcc

SEQ ID NO: 478923 - DNA, 15 bp, Homo sapiens
aacaaataatctcct

SEQ ID NO: 478924 - DNA, 15 bp, Homo sapiens
acaaataatctccta

SEQ ID NO: 478925 - DNA, 15 bp, Homo sapiens
caaataatctcctat

SEQ ID NO: 478926 - DNA, 15 bp, Homo sapiens
aaataatctcctatg

SEQ ID NO: 478927 - DNA, 15 bp, Homo sapiens
aataatctcctatga

SEQ ID NO: 478928 - DNA, 15 bp, Homo sapiens
ataatctcctatgaa

SEQ ID NO: 478929 - DNA, 15 bp, Homo sapiens
taatctcctatgaac

SEQ ID NO: 478930 - DNA, 15 bp, Homo sapiens
aatctcctatgaacc

SEQ ID NO: 478931 - DNA, 15 bp, Homo sapiens
atctcctatgaaccc

SEQ ID NO: 478932 - DNA, 15 bp, Homo sapiens
tctcctatgaaccct

SEQ ID NO: 478933 - DNA, 15 bp, Homo sapiens
ctcctatgaacccta

SEQ ID NO: 478934 - DNA, 15 bp, Homo sapiens
tcctatgaaccctag

SEQ ID NO: 478935 - DNA, 15 bp, Homo sapiens
cctatgaaccctagg

SEQ ID NO: 478936 - DNA, 15 bp, Homo sapiens
ctatgaaccctagga

SEQ ID NO: 478937 - DNA, 15 bp, Homo sapiens
tatgaaccctaggat

SEQ ID NO: 478938 - DNA, 15 bp, Homo sapiens
atgaaccctaggatg

SEQ ID NO: 478939 - DNA, 15 bp, Homo sapiens
tgaaccctaggatgg

SEQ ID NO: 478940 - DNA, 15 bp, Homo sapiens
gaaccctaggatggg

SEQ ID NO: 478941 - DNA, 15 bp, Homo sapiens
aaccctaggatgggc

SEQ ID NO: 478942 - DNA, 15 bp, Homo sapiens
accctaggatgggca

SEQ ID NO: 478943 - DNA, 15 bp, Homo sapiens
ccctaggatgggcat

SEQ ID NO: 478944 - DNA, 15 bp, Homo sapiens
cctaggatgggcatt

SEQ ID NO: 478945 - DNA, 15 bp, Homo sapiens
ctaggatgggcatta

SEQ ID NO: 478946 - DNA, 15 bp, Homo sapiens
taggatgggcattat

SEQ ID NO: 478947 - DNA, 15 bp, Homo sapiens
aggatgggcattatt

SEQ ID NO: 478948 - DNA, 15 bp, Homo sapiens
ggatgggcattatta

SEQ ID NO: 478949 - DNA, 15 bp, Homo sapiens
gatgggcattattat

SEQ ID NO: 478950 - DNA, 15 bp, Homo sapiens
atgggcattattatg

SEQ ID NO: 478951 - DNA, 15 bp, Homo sapiens
tgggcattattatga

SEQ ID NO: 478952 - DNA, 15 bp, Homo sapiens
gggcattattatgag

SEQ ID NO: 478953 - DNA, 15 bp, Homo sapiens
ggcattattatgagt

SEQ ID NO: 478954 - DNA, 15 bp, Homo sapiens
gcattattatgagtc

SEQ ID NO: 478955 - DNA, 15 bp, Homo sapiens
cattattatgagtcc

SEQ ID NO: 478956 - DNA, 15 bp, Homo sapiens
attattatgagtcct

SEQ ID NO: 478957 - DNA, 15 bp, Homo sapiens
ttattatgagtccta

SEQ ID NO: 478958 - DNA, 15 bp, Homo sapiens
tattatgagtcctat

SEQ ID NO: 478959 - DNA, 15 bp, Homo sapiens
attatgagtcctatt

SEQ ID NO: 478960 - DNA, 15 bp, Homo sapiens
ttatgagtcctattt

SEQ ID NO: 478961 - DNA, 15 bp, Homo sapiens
tatgagtcctatttt

SEQ ID NO: 478962 - DNA, 15 bp, Homo sapiens
atgagtcctatttta

SEQ ID NO: 478963 - DNA, 15 bp, Homo sapiens
tgagtcctattttat

SEQ ID NO: 478964 - DNA, 15 bp, Homo sapiens
gagtcctattttata

SEQ ID NO: 478965 - DNA, 15 bp, Homo sapiens
agtcctattttataa

SEQ ID NO: 478966 - DNA, 15 bp, Homo sapiens
gtcctattttataaa

SEQ ID NO: 478967 - DNA, 15 bp, Homo sapiens
tcctattttataaac

SEQ ID NO: 478968 - DNA, 15 bp, Homo sapiens
cctattttataaaca

SEQ ID NO: 478969 - DNA, 15 bp, Homo sapiens
ctattttataaacaa

SEQ ID NO: 478970 - DNA, 15 bp, Homo sapiens
tattttataaacaag

SEQ ID NO: 478971 - DNA, 15 bp, Homo sapiens
attttataaacaagg

SEQ ID NO: 478972 - DNA, 15 bp, Homo sapiens
ttttataaacaagga

SEQ ID NO: 478973 - DNA, 15 bp, Homo sapiens
tttataaacaaggaa

SEQ ID NO: 478974 - DNA, 15 bp, Homo sapiens
ttataaacaaggaag

SEQ ID NO: 478975 - DNA, 15 bp, Homo sapiens
tataaacaaggaagc

SEQ ID NO: 478976 - DNA, 15 bp, Homo sapiens
ataaacaaggaagct

SEQ ID NO: 478977 - DNA, 15 bp, Homo sapiens
taaacaaggaagctg

SEQ ID NO: 478978 - DNA, 15 bp, Homo sapiens
aaacaaggaagctga

SEQ ID NO: 478979 - DNA, 15 bp, Homo sapiens
aacaaggaagctgac

SEQ ID NO: 478980 - DNA, 15 bp, Homo sapiens
acaaggaagctgaca

SEQ ID NO: 478981 - DNA, 15 bp, Homo sapiens
caaggaagctgacat

SEQ ID NO: 478982 - DNA, 15 bp, Homo sapiens
aaggaagctgacatc

SEQ ID NO: 478983 - DNA, 15 bp, Homo sapiens
aggaagctgacatcc

SEQ ID NO: 478984 - DNA, 15 bp, Homo sapiens
ggaagctgacatcca

SEQ ID NO: 478985 - DNA, 15 bp, Homo sapiens
gaagctgacatccag

SEQ ID NO: 478986 - DNA, 15 bp, Homo sapiens
aagctgacatccaga

SEQ ID NO: 478987 - DNA, 15 bp, Homo sapiens
agctgacatccagaa

SEQ ID NO: 478988 - DNA, 15 bp, Homo sapiens
gctgacatccagaaa

SEQ ID NO: 478989 - DNA, 15 bp, Homo sapiens
ctgacatccagaaag

SEQ ID NO: 478990 - DNA, 15 bp, Homo sapiens
tgacatccagaaaga

SEQ ID NO: 478991 - DNA, 15 bp, Homo sapiens
gacatccagaaagat

SEQ ID NO: 478992 - DNA, 15 bp, Homo sapiens
acatccagaaagata

SEQ ID NO: 478993 - DNA, 15 bp, Homo sapiens
catccagaaagataa

SEQ ID NO: 478994 - DNA, 15 bp, Homo sapiens
atccagaaagataaa

SEQ ID NO: 478995 - DNA, 15 bp, Homo sapiens
tccagaaagataaat

SEQ ID NO: 478996 - DNA, 15 bp, Homo sapiens
ccagaaagataaatg

SEQ ID NO: 478997 - DNA, 15 bp, Homo sapiens
cagaaagataaatga

SEQ ID NO: 478998 - DNA, 15 bp, Homo sapiens
agaaagataaatgac

SEQ ID NO: 478999 - DNA, 15 bp, Homo sapiens
gaaagataaatgaca

SEQ ID NO: 479000 - DNA, 15 bp, Homo sapiens
aaagataaatgacat

SEQ ID NO: 479001 - DNA, 15 bp, Homo sapiens
aagataaatgacatg

SEQ ID NO: 479002 - DNA, 15 bp, Homo sapiens
agataaatgacatgt

SEQ ID NO: 479003 - DNA, 15 bp, Homo sapiens
gataaatgacatgtc

SEQ ID NO: 479004 - DNA, 15 bp, Homo sapiens
ataaatgacatgtcc

SEQ ID NO: 479005 - DNA, 15 bp, Homo sapiens
taaatgacatgtccc

SEQ ID NO: 479006 - DNA, 15 bp, Homo sapiens
aaatgacatgtccct

SEQ ID NO: 479007 - DNA, 15 bp, Homo sapiens
aatgacatgtccctg

SEQ ID NO: 479008 - DNA, 15 bp, Homo sapiens
atgacatgtccctga

SEQ ID NO: 479009 - DNA, 15 bp, Homo sapiens
tgacatgtccctgat

SEQ ID NO: 479010 - DNA, 15 bp, Homo sapiens
gacatgtccctgatc

SEQ ID NO: 479011 - DNA, 15 bp, Homo sapiens
acatgtccctgatca

SEQ ID NO: 479012 - DNA, 15 bp, Homo sapiens
catgtccctgatcac

SEQ ID NO: 479013 - DNA, 15 bp, Homo sapiens
atgtccctgatcacc

SEQ ID NO: 479014 - DNA, 15 bp, Homo sapiens
tgtccctgatcaccc

SEQ ID NO: 479015 - DNA, 15 bp, Homo sapiens
gtccctgatcaccca

SEQ ID NO: 479016 - DNA, 15 bp, Homo sapiens
tccctgatcacccat

SEQ ID NO: 479017 - DNA, 15 bp, Homo sapiens
ccctgatcacccata

SEQ ID NO: 479018 - DNA, 15 bp, Homo sapiens
cctgatcacccatat

SEQ ID NO: 479019 - DNA, 15 bp, Homo sapiens
ctgatcacccatata

SEQ ID NO: 479020 - DNA, 15 bp, Homo sapiens
tgatcacccatatat

SEQ ID NO: 479021 - DNA, 15 bp, Homo sapiens
gatcacccatatatc

SEQ ID NO: 479022 - DNA, 15 bp, Homo sapiens
atcacccatatatct

SEQ ID NO: 479023 - DNA, 15 bp, Homo sapiens
tcacccatatatcta

SEQ ID NO: 479024 - DNA, 15 bp, Homo sapiens
cacccatatatctat

SEQ ID NO: 479025 - DNA, 15 bp, Homo sapiens
acccatatatctatt

SEQ ID NO: 479026 - DNA, 15 bp, Homo sapiens
cccatatatctatta

SEQ ID NO: 479027 - DNA, 15 bp, Homo sapiens
ccatatatctattac

SEQ ID NO: 479028 - DNA, 15 bp, Homo sapiens
catatatctattaca

SEQ ID NO: 479029 - DNA, 15 bp, Homo sapiens
atatatctattacaa

SEQ ID NO: 479030 - DNA, 15 bp, Homo sapiens
tatatctattacaat

SEQ ID NO: 479031 - DNA, 15 bp, Homo sapiens
atatctattacaatt

SEQ ID NO: 479032 - DNA, 15 bp, Homo sapiens
tatctattacaatta

SEQ ID NO: 479033 - DNA, 15 bp, Homo sapiens
atctattacaattag

SEQ ID NO: 479034 - DNA, 15 bp, Homo sapiens
tctattacaattaga

SEQ ID NO: 479035 - DNA, 15 bp, Homo sapiens
ctattacaattagat

SEQ ID NO: 479036 - DNA, 15 bp, Homo sapiens
tattacaattagata

SEQ ID NO: 479037 - DNA, 15 bp, Homo sapiens
attacaattagatac

SEQ ID NO: 479038 - DNA, 15 bp, Homo sapiens
ttacaattagataca

SEQ ID NO: 479039 - DNA, 15 bp, Homo sapiens
tacaattagatacat

SEQ ID NO: 479040 - DNA, 15 bp, Homo sapiens
acaattagatacatg

SEQ ID NO: 479041 - DNA, 15 bp, Homo sapiens
caattagatacatga

SEQ ID NO: 479042 - DNA, 15 bp, Homo sapiens
aattagatacatgag

SEQ ID NO: 479043 - DNA, 15 bp, Homo sapiens
attagatacatgagt

SEQ ID NO: 479044 - DNA, 15 bp, Homo sapiens
ttagatacatgagta

SEQ ID NO: 479045 - DNA, 15 bp, Homo sapiens
tagatacatgagtac

SEQ ID NO: 479046 - DNA, 15 bp, Homo sapiens
agatacatgagtacg

SEQ ID NO: 479047 - DNA, 15 bp, Homo sapiens
gatacatgagtacgt

SEQ ID NO: 479048 - DNA, 15 bp, Homo sapiens
atacatgagtacgtt

SEQ ID NO: 479049 - DNA, 15 bp, Homo sapiens
tacatgagtacgttc

SEQ ID NO: 479050 - DNA, 15 bp, Homo sapiens
acatgagtacgttcg

SEQ ID NO: 479051 - DNA, 15 bp, Homo sapiens
catgagtacgttcga

SEQ ID NO: 479052 - DNA, 15 bp, Homo sapiens
atgagtacgttcgat

SEQ ID NO: 479053 - DNA, 15 bp, Homo sapiens
tgagtacgttcgatt

SEQ ID NO: 479054 - DNA, 15 bp, Homo sapiens
gagtacgttcgattg

SEQ ID NO: 479055 - DNA, 15 bp, Homo sapiens
agtacgttcgattga

SEQ ID NO: 479056 - DNA, 15 bp, Homo sapiens
gtacgttcgattgac

SEQ ID NO: 479057 - DNA, 15 bp, Homo sapiens
tacgttcgattgact

SEQ ID NO: 479058 - DNA, 15 bp, Homo sapiens
acgttcgattgactc

SEQ ID NO: 479059 - DNA, 15 bp, Homo sapiens
cgttcgattgactct

SEQ ID NO: 479060 - DNA, 15 bp, Homo sapiens
gttcgattgactctg

SEQ ID NO: 479061 - DNA, 15 bp, Homo sapiens
ttcgattgactctgg

SEQ ID NO: 479062 - DNA, 15 bp, Homo sapiens
tcgattgactctgga

SEQ ID NO: 479063 - DNA, 15 bp, Homo sapiens
cgattgactctggac

SEQ ID NO: 479064 - DNA, 15 bp, Homo sapiens
gattgactctggaca

SEQ ID NO: 479065 - DNA, 15 bp, Homo sapiens
attgactctggacaa

SEQ ID NO: 479066 - DNA, 15 bp, Homo sapiens
ttgactctggacaat

SEQ ID NO: 479067 - DNA, 15 bp, Homo sapiens
tgactctggacaatt

SEQ ID NO: 479068 - DNA, 15 bp, Homo sapiens
gactctggacaattt

SEQ ID NO: 479069 - DNA, 15 bp, Homo sapiens
actctggacaattta

SEQ ID NO: 479070 - DNA, 15 bp, Homo sapiens
ctctggacaatttaa

SEQ ID NO: 479071 - DNA, 15 bp, Homo sapiens
tctggacaatttaaa

SEQ ID NO: 479072 - DNA, 15 bp, Homo sapiens
ctggacaatttaaaa

SEQ ID NO: 479073 - DNA, 15 bp, Homo sapiens
tggacaatttaaaag

SEQ ID NO: 479074 - DNA, 15 bp, Homo sapiens
ggacaatttaaaagg

SEQ ID NO: 479075 - DNA, 15 bp, Homo sapiens
gacaatttaaaagga

SEQ ID NO: 479076 - DNA, 15 bp, Homo sapiens
acaatttaaaaggaa

SEQ ID NO: 479077 - DNA, 15 bp, Homo sapiens
caatttaaaaggaaa

SEQ ID NO: 479078 - DNA, 15 bp, Homo sapiens
aatttaaaaggaaat

SEQ ID NO: 479079 - DNA, 15 bp, Homo sapiens
atttaaaaggaaatt

SEQ ID NO: 479080 - DNA, 15 bp, Homo sapiens
tttaaaaggaaattg

SEQ ID NO: 479081 - DNA, 15 bp, Homo sapiens
ttaaaaggaaattga

SEQ ID NO: 479082 - DNA, 15 bp, Homo sapiens
taaaaggaaattgat

SEQ ID NO: 479083 - DNA, 15 bp, Homo sapiens
aaaaggaaattgatg

SEQ ID NO: 479084 - DNA, 15 bp, Homo sapiens
aaaggaaattgatgt

SEQ ID NO: 479085 - DNA, 15 bp, Homo sapiens
aaggaaattgatgtt

SEQ ID NO: 479086 - DNA, 15 bp, Homo sapiens
aggaaattgatgtta

SEQ ID NO: 479087 - DNA, 15 bp, Homo sapiens
ggaaattgatgttac

SEQ ID NO: 479088 - DNA, 15 bp, Homo sapiens
gaaattgatgttacg

SEQ ID NO: 479089 - DNA, 15 bp, Homo sapiens
aaattgatgttacga

SEQ ID NO: 479090 - DNA, 15 bp, Homo sapiens
aattgatgttacgaa

SEQ ID NO: 479091 - DNA, 15 bp, Homo sapiens
attgatgttacgaat

SEQ ID NO: 479092 - DNA, 15 bp, Homo sapiens
ttgatgttacgaata

SEQ ID NO: 479093 - DNA, 15 bp, Homo sapiens
tgatgttacgaatac

SEQ ID NO: 479094 - DNA, 15 bp, Homo sapiens
gatgttacgaatact

SEQ ID NO: 479095 - DNA, 15 bp, Homo sapiens
atgttacgaatacta

SEQ ID NO: 479096 - DNA, 15 bp, Homo sapiens
tgttacgaatactac

SEQ ID NO: 479097 - DNA, 15 bp, Homo sapiens
gttacgaatactaca

SEQ ID NO: 479098 - DNA, 15 bp, Homo sapiens
ttacgaatactacat

SEQ ID NO: 479099 - DNA, 15 bp, Homo sapiens
tacgaatactacata

SEQ ID NO: 479100 - DNA, 15 bp, Homo sapiens
acgaatactacatat

SEQ ID NO: 479101 - DNA, 15 bp, Homo sapiens
cgaatactacatatc

SEQ ID NO: 479102 - DNA, 15 bp, Homo sapiens
gaatactacatatct

SEQ ID NO: 479103 - DNA, 15 bp, Homo sapiens
aatactacatatctt

SEQ ID NO: 479104 - DNA, 15 bp, Homo sapiens
atactacatatcttt

SEQ ID NO: 479105 - DNA, 15 bp, Homo sapiens
tactacatatctttg

SEQ ID NO: 479106 - DNA, 15 bp, Homo sapiens
actacatatctttga

SEQ ID NO: 479107 - DNA, 15 bp, Homo sapiens
ctacatatctttgaa

SEQ ID NO: 479108 - DNA, 15 bp, Homo sapiens
tacatatctttgaag

SEQ ID NO: 479109 - DNA, 15 bp, Homo sapiens
acatatctttgaagg

SEQ ID NO: 479110 - DNA, 15 bp, Homo sapiens
catatctttgaagga

SEQ ID NO: 479111 - DNA, 15 bp, Homo sapiens
atatctttgaaggaa

SEQ ID NO: 479112 - DNA, 15 bp, Homo sapiens
tatctttgaaggaaa

SEQ ID NO: 479113 - DNA, 15 bp, Homo sapiens
atctttgaaggaaaa

SEQ ID NO: 479114 - DNA, 15 bp, Homo sapiens
tctttgaaggaaaaa

SEQ ID NO: 479115 - DNA, 15 bp, Homo sapiens
ctttgaaggaaaaat

SEQ ID NO: 479116 - DNA, 15 bp, Homo sapiens
tttgaaggaaaaatt

SEQ ID NO: 479117 - DNA, 15 bp, Homo sapiens
ttgaaggaaaaattg

SEQ ID NO: 479118 - DNA, 15 bp, Homo sapiens
tgaaggaaaaattga

SEQ ID NO: 479119 - DNA, 15 bp, Homo sapiens
gaaggaaaaattgag

SEQ ID NO: 479120 - DNA, 15 bp, Homo sapiens
aaggaaaaattgagc

SEQ ID NO: 479121 - DNA, 15 bp, Homo sapiens
aggaaaaattgagca

SEQ ID NO: 479122 - DNA, 15 bp, Homo sapiens
ggaaaaattgagcag

SEQ ID NO: 479123 - DNA, 15 bp, Homo sapiens
gaaaaattgagcagt

SEQ ID NO: 479124 - DNA, 15 bp, Homo sapiens
aaaaattgagcagtg

SEQ ID NO: 479125 - DNA, 15 bp, Homo sapiens
aaaattgagcagtga

SEQ ID NO: 479126 - DNA, 15 bp, Homo sapiens
aaattgagcagtgac

SEQ ID NO: 479127 - DNA, 15 bp, Homo sapiens
aattgagcagtgaca

SEQ ID NO: 479128 - DNA, 15 bp, Homo sapiens
attgagcagtgacat

SEQ ID NO: 479129 - DNA, 15 bp, Homo sapiens
ttgagcagtgacatc

SEQ ID NO: 479130 - DNA, 15 bp, Homo sapiens
tgagcagtgacatct

SEQ ID NO: 479131 - DNA, 15 bp, Homo sapiens
gagcagtgacatctc

SEQ ID NO: 479132 - DNA, 15 bp, Homo sapiens
agcagtgacatctca

SEQ ID NO: 479133 - DNA, 15 bp, Homo sapiens
gcagtgacatctcag

SEQ ID NO: 479134 - DNA, 15 bp, Homo sapiens
cagtgacatctcagg

SEQ ID NO: 479135 - DNA, 15 bp, Homo sapiens
agtgacatctcagga

SEQ ID NO: 479136 - DNA, 15 bp, Homo sapiens
gtgacatctcaggac

SEQ ID NO: 479137 - DNA, 15 bp, Homo sapiens
tgacatctcaggaca

SEQ ID NO: 479138 - DNA, 15 bp, Homo sapiens
gacatctcaggacag

SEQ ID NO: 479139 - DNA, 15 bp, Homo sapiens
acatctcaggacagg

SEQ ID NO: 479140 - DNA, 15 bp, Homo sapiens
catctcaggacagga

SEQ ID NO: 479141 - DNA, 15 bp, Homo sapiens
atctcaggacaggat

SEQ ID NO: 479142 - DNA, 15 bp, Homo sapiens
tctcaggacaggata

SEQ ID NO: 479143 - DNA, 15 bp, Homo sapiens
ctcaggacaggatag

SEQ ID NO: 479144 - DNA, 15 bp, Homo sapiens
tcaggacaggatagg

SEQ ID NO: 479145 - DNA, 15 bp, Homo sapiens
caggacaggatagga

SEQ ID NO: 479146 - DNA, 15 bp, Homo sapiens
aggacaggataggac

SEQ ID NO: 479147 - DNA, 15 bp, Homo sapiens
ggacaggataggact

SEQ ID NO: 479148 - DNA, 15 bp, Homo sapiens
gacaggataggactc

SEQ ID NO: 479149 - DNA, 15 bp, Homo sapiens
acaggataggactca

SEQ ID NO: 479150 - DNA, 15 bp, Homo sapiens
caggataggactcat

SEQ ID NO: 479151 - DNA, 15 bp, Homo sapiens
aggataggactcatg

SEQ ID NO: 479152 - DNA, 15 bp, Homo sapiens
ggataggactcatga

SEQ ID NO: 479153 - DNA, 15 bp, Homo sapiens
gataggactcatgac

SEQ ID NO: 479154 - DNA, 15 bp, Homo sapiens
ataggactcatgacg

SEQ ID NO: 479155 - DNA, 15 bp, Homo sapiens
taggactcatgacgg

SEQ ID NO: 479156 - DNA, 15 bp, Homo sapiens
aggactcatgacggt

SEQ ID NO: 479157 - DNA, 15 bp, Homo sapiens
ggactcatgacggtt

SEQ ID NO: 479158 - DNA, 15 bp, Homo sapiens
gactcatgacggttc

SEQ ID NO: 479159 - DNA, 15 bp, Homo sapiens
actcatgacggttct

SEQ ID NO: 479160 - DNA, 15 bp, Homo sapiens
ctcatgacggttctg

SEQ ID NO: 479161 - DNA, 15 bp, Homo sapiens
tcatgacggttctgg

SEQ ID NO: 479162 - DNA, 15 bp, Homo sapiens
catgacggttctggg

SEQ ID NO: 479163 - DNA, 15 bp, Homo sapiens
atgacggttctgggg

SEQ ID NO: 479164 - DNA, 15 bp, Homo sapiens
tgacggttctgggga

SEQ ID NO: 479165 - DNA, 15 bp, Homo sapiens
gacggttctggggaa

SEQ ID NO: 479166 - DNA, 15 bp, Homo sapiens
acggttctggggaat

SEQ ID NO: 479167 - DNA, 15 bp, Homo sapiens
cggttctggggaatc

SEQ ID NO: 479168 - DNA, 15 bp, Homo sapiens
ggttctggggaatct

SEQ ID NO: 479169 - DNA, 15 bp, Homo sapiens
gttctggggaatctc

SEQ ID NO: 479170 - DNA, 15 bp, Homo sapiens
ttctggggaatctca

SEQ ID NO: 479171 - DNA, 15 bp, Homo sapiens
tctggggaatctcag

SEQ ID NO: 479172 - DNA, 15 bp, Homo sapiens
ctggggaatctcaga

SEQ ID NO: 479173 - DNA, 15 bp, Homo sapiens
tggggaatctcagaa

SEQ ID NO: 479174 - DNA, 15 bp, Homo sapiens
ggggaatctcagaag

SEQ ID NO: 479175 - DNA, 15 bp, Homo sapiens
gggaatctcagaagt

SEQ ID NO: 479176 - DNA, 15 bp, Homo sapiens
ggaatctcagaagtg

SEQ ID NO: 479177 - DNA, 15 bp, Homo sapiens
gaatctcagaagtgg

SEQ ID NO: 479178 - DNA, 15 bp, Homo sapiens
aatctcagaagtggg

SEQ ID NO: 479179 - DNA, 15 bp, Homo sapiens
atctcagaagtggga

SEQ ID NO: 479180 - DNA, 15 bp, Homo sapiens
tctcagaagtgggaa

SEQ ID NO: 479181 - DNA, 15 bp, Homo sapiens
ctcagaagtgggaac

SEQ ID NO: 479182 - DNA, 15 bp, Homo sapiens
tcagaagtgggaacg

SEQ ID NO: 479183 - DNA, 15 bp, Homo sapiens
cagaagtgggaacgc

SEQ ID NO: 479184 - DNA, 15 bp, Homo sapiens
agaagtgggaacgca

SEQ ID NO: 479185 - DNA, 15 bp, Homo sapiens
gaagtgggaacgcaa

SEQ ID NO: 479186 - DNA, 15 bp, Homo sapiens
aagtgggaacgcaag

SEQ ID NO: 479187 - DNA, 15 bp, Homo sapiens
agtgggaacgcaagg

SEQ ID NO: 479188 - DNA, 15 bp, Homo sapiens
gtgggaacgcaagga

SEQ ID NO: 479189 - DNA, 15 bp, Homo sapiens
tgggaacgcaaggac

SEQ ID NO: 479190 - DNA, 15 bp, Homo sapiens
gggaacgcaaggaca

SEQ ID NO: 479191 - DNA, 15 bp, Homo sapiens
ggaacgcaaggacaa

SEQ ID NO: 479192 - DNA, 15 bp, Homo sapiens
gaacgcaaggacaat

SEQ ID NO: 479193 - DNA, 15 bp, Homo sapiens
aacgcaaggacaatt

SEQ ID NO: 479194 - DNA, 15 bp, Homo sapiens
acgcaaggacaattc

SEQ ID NO: 479195 - DNA, 15 bp, Homo sapiens
cgcaaggacaattcc

SEQ ID NO: 479196 - DNA, 15 bp, Homo sapiens
gcaaggacaattcct

SEQ ID NO: 479197 - DNA, 15 bp, Homo sapiens
caaggacaattcctt

SEQ ID NO: 479198 - DNA, 15 bp, Homo sapiens
aaggacaattccttg

SEQ ID NO: 479199 - DNA, 15 bp, Homo sapiens
aggacaattccttgg

SEQ ID NO: 479200 - DNA, 15 bp, Homo sapiens
ggacaattccttggg

SEQ ID NO: 479201 - DNA, 15 bp, Homo sapiens
gacaattccttgggc

SEQ ID NO: 479202 - DNA, 15 bp, Homo sapiens
acaattccttgggcc

SEQ ID NO: 479203 - DNA, 15 bp, Homo sapiens
caattccttgggcca

SEQ ID NO: 479204 - DNA, 15 bp, Homo sapiens
aattccttgggccat

SEQ ID NO: 479205 - DNA, 15 bp, Homo sapiens
attccttgggccatg

SEQ ID NO: 479206 - DNA, 15 bp, Homo sapiens
ttccttgggccatgg

SEQ ID NO: 479207 - DNA, 15 bp, Homo sapiens
tccttgggccatggc

SEQ ID NO: 479208 - DNA, 15 bp, Homo sapiens
ccttgggccatggct

SEQ ID NO: 479209 - DNA, 15 bp, Homo sapiens
cttgggccatggcta

SEQ ID NO: 479210 - DNA, 15 bp, Homo sapiens
ttgggccatggctat

SEQ ID NO: 479211 - DNA, 15 bp, Homo sapiens
tgggccatggctatc

SEQ ID NO: 479212 - DNA, 15 bp, Homo sapiens
gggccatggctatca

SEQ ID NO: 479213 - DNA, 15 bp, Homo sapiens
ggccatggctatcag

SEQ ID NO: 479214 - DNA, 15 bp, Homo sapiens
gccatggctatcagg

SEQ ID NO: 479215 - DNA, 15 bp, Homo sapiens
ccatggctatcagga

SEQ ID NO: 479216 - DNA, 15 bp, Homo sapiens
catggctatcaggac

SEQ ID NO: 479217 - DNA, 15 bp, Homo sapiens
atggctatcaggacg

SEQ ID NO: 479218 - DNA, 15 bp, Homo sapiens
tggctatcaggacgt

SEQ ID NO: 479219 - DNA, 15 bp, Homo sapiens
ggctatcaggacgtc

SEQ ID NO: 479220 - DNA, 15 bp, Homo sapiens
gctatcaggacgtct

SEQ ID NO: 479221 - DNA, 15 bp, Homo sapiens
ctatcaggacgtctc

SEQ ID NO: 479222 - DNA, 15 bp, Homo sapiens
tatcaggacgtctca

SEQ ID NO: 479223 - DNA, 15 bp, Homo sapiens
atcaggacgtctcac

SEQ ID NO: 479224 - DNA, 15 bp, Homo sapiens
tcaggacgtctcact

SEQ ID NO: 479225 - DNA, 15 bp, Homo sapiens
caggacgtctcactc

SEQ ID NO: 479226 - DNA, 15 bp, Homo sapiens
aggacgtctcactcc

SEQ ID NO: 479227 - DNA, 15 bp, Homo sapiens
ggacgtctcactcca

SEQ ID NO: 479228 - DNA, 15 bp, Homo sapiens
gacgtctcactccat

SEQ ID NO: 479229 - DNA, 15 bp, Homo sapiens
acgtctcactccatc

SEQ ID NO: 479230 - DNA, 15 bp, Homo sapiens
cgtctcactccatct

SEQ ID NO: 479231 - DNA, 15 bp, Homo sapiens
gtctcactccatctg

SEQ ID NO: 479232 - DNA, 15 bp, Homo sapiens
tctcactccatctgc

SEQ ID NO: 479233 - DNA, 15 bp, Homo sapiens
ctcactccatctgcc

SEQ ID NO: 479234 - DNA, 15 bp, Homo sapiens
tcactccatctgcca

SEQ ID NO: 479235 - DNA, 15 bp, Homo sapiens
cactccatctgccat

SEQ ID NO: 479236 - DNA, 15 bp, Homo sapiens
actccatctgccatc

SEQ ID NO: 479237 - DNA, 15 bp, Homo sapiens
ctccatctgccatct

SEQ ID NO: 479238 - DNA, 15 bp, Homo sapiens
tccatctgccatctg

SEQ ID NO: 479239 - DNA, 15 bp, Homo sapiens
ccatctgccatctgc

SEQ ID NO: 479240 - DNA, 15 bp, Homo sapiens
catctgccatctgcc

SEQ ID NO: 479241 - DNA, 15 bp, Homo sapiens
atctgccatctgccc

SEQ ID NO: 479242 - DNA, 15 bp, Homo sapiens
tctgccatctgccct

SEQ ID NO: 479243 - DNA, 15 bp, Homo sapiens
ctgccatctgccctt

SEQ ID NO: 479244 - DNA, 15 bp, Homo sapiens
tgccatctgcccttg

SEQ ID NO: 479245 - DNA, 15 bp, Homo sapiens
gccatctgcccttgg

SEQ ID NO: 479246 - DNA, 15 bp, Homo sapiens
ccatctgcccttggg

SEQ ID NO: 479247 - DNA, 15 bp, Homo sapiens
catctgcccttgggt

SEQ ID NO: 479248 - DNA, 15 bp, Homo sapiens
atctgcccttgggtg

SEQ ID NO: 479249 - DNA, 15 bp, Homo sapiens
tctgcccttgggtga

SEQ ID NO: 479250 - DNA, 15 bp, Homo sapiens
ctgcccttgggtgac

SEQ ID NO: 479251 - DNA, 15 bp, Homo sapiens
tgcccttgggtgaca

SEQ ID NO: 479252 - DNA, 15 bp, Homo sapiens
gcccttgggtgacac

SEQ ID NO: 479253 - DNA, 15 bp, Homo sapiens
cccttgggtgacact

SEQ ID NO: 479254 - DNA, 15 bp, Homo sapiens
ccttgggtgacactg

SEQ ID NO: 479255 - DNA, 15 bp, Homo sapiens
cttgggtgacactgg

SEQ ID NO: 479256 - DNA, 15 bp, Homo sapiens
ttgggtgacactgga

SEQ ID NO: 479257 - DNA, 15 bp, Homo sapiens
tgggtgacactggaa

SEQ ID NO: 479258 - DNA, 15 bp, Homo sapiens
gggtgacactggaaa

SEQ ID NO: 479259 - DNA, 15 bp, Homo sapiens
ggtgacactggaaag

SEQ ID NO: 479260 - DNA, 15 bp, Homo sapiens
gtgacactggaaaga

SEQ ID NO: 479261 - DNA, 15 bp, Homo sapiens
tgacactggaaagaa

SEQ ID NO: 479262 - DNA, 15 bp, Homo sapiens
gacactggaaagaaa

SEQ ID NO: 479263 - DNA, 15 bp, Homo sapiens
acactggaaagaaag

SEQ ID NO: 479264 - DNA, 15 bp, Homo sapiens
cactggaaagaaaga

SEQ ID NO: 479265 - DNA, 15 bp, Homo sapiens
actggaaagaaagaa

SEQ ID NO: 479266 - DNA, 15 bp, Homo sapiens
ctggaaagaaagaat

SEQ ID NO: 479267 - DNA, 15 bp, Homo sapiens
tggaaagaaagaatg

SEQ ID NO: 479268 - DNA, 15 bp, Homo sapiens
ggaaagaaagaatgg

SEQ ID NO: 479269 - DNA, 15 bp, Homo sapiens
gaaagaaagaatggg

SEQ ID NO: 479270 - DNA, 15 bp, Homo sapiens
aaagaaagaatgggg

SEQ ID NO: 479271 - DNA, 15 bp, Homo sapiens
aagaaagaatgggga

SEQ ID NO: 479272 - DNA, 15 bp, Homo sapiens
agaaagaatggggag

SEQ ID NO: 479273 - DNA, 15 bp, Homo sapiens
gaaagaatggggagg

SEQ ID NO: 479274 - DNA, 15 bp, Homo sapiens
aaagaatggggaggc

SEQ ID NO: 479275 - DNA, 15 bp, Homo sapiens
aagaatggggaggct

SEQ ID NO: 479276 - DNA, 15 bp, Homo sapiens
agaatggggaggctg

SEQ ID NO: 479277 - DNA, 15 bp, Homo sapiens
gaatggggaggctga

SEQ ID NO: 479278 - DNA, 15 bp, Homo sapiens
aatggggaggctgac

SEQ ID NO: 479279 - DNA, 15 bp, Homo sapiens
atggggaggctgact

SEQ ID NO: 479280 - DNA, 15 bp, Homo sapiens
tggggaggctgactg

SEQ ID NO: 479281 - DNA, 15 bp, Homo sapiens
ggggaggctgactgt

SEQ ID NO: 479282 - DNA, 15 bp, Homo sapiens
gggaggctgactgtg

SEQ ID NO: 479283 - DNA, 15 bp, Homo sapiens
ggaggctgactgtgg

SEQ ID NO: 479284 - DNA, 15 bp, Homo sapiens
gaggctgactgtggt

SEQ ID NO: 479285 - DNA, 15 bp, Homo sapiens
aggctgactgtggtt

SEQ ID NO: 479286 - DNA, 15 bp, Homo sapiens
ggctgactgtggttt

SEQ ID NO: 479287 - DNA, 15 bp, Homo sapiens
gctgactgtggttta

SEQ ID NO: 479288 - DNA, 15 bp, Homo sapiens
ctgactgtggtttac

SEQ ID NO: 479289 - DNA, 15 bp, Homo sapiens
tgactgtggtttaca

SEQ ID NO: 479290 - DNA, 15 bp, Homo sapiens
gactgtggtttacac

SEQ ID NO: 479291 - DNA, 15 bp, Homo sapiens
actgtggtttacaca

SEQ ID NO: 479292 - DNA, 15 bp, Homo sapiens
ctgtggtttacacag

SEQ ID NO: 479293 - DNA, 15 bp, Homo sapiens
tgtggtttacacagg

SEQ ID NO: 479294 - DNA, 15 bp, Homo sapiens
gtggtttacacaggc

SEQ ID NO: 479295 - DNA, 15 bp, Homo sapiens
tggtttacacaggca

SEQ ID NO: 479296 - DNA, 15 bp, Homo sapiens
ggtttacacaggcat

SEQ ID NO: 479297 - DNA, 15 bp, Homo sapiens
gtttacacaggcatt

SEQ ID NO: 479298 - DNA, 15 bp, Homo sapiens
tttacacaggcattg

SEQ ID NO: 479299 - DNA, 15 bp, Homo sapiens
ttacacaggcattgc

SEQ ID NO: 479300 - DNA, 15 bp, Homo sapiens
tacacaggcattgca

SEQ ID NO: 479301 - DNA, 15 bp, Homo sapiens
acacaggcattgcag

SEQ ID NO: 479302 - DNA, 15 bp, Homo sapiens
cacaggcattgcagt

SEQ ID NO: 479303 - DNA, 15 bp, Homo sapiens
acaggcattgcagtt

SEQ ID NO: 479304 - DNA, 15 bp, Homo sapiens
caggcattgcagttt

SEQ ID NO: 479305 - DNA, 15 bp, Homo sapiens
aggcattgcagtttg

SEQ ID NO: 479306 - DNA, 15 bp, Homo sapiens
ggcattgcagtttgc

SEQ ID NO: 479307 - DNA, 15 bp, Homo sapiens
gcattgcagtttgca

SEQ ID NO: 479308 - DNA, 15 bp, Homo sapiens
cattgcagtttgcaa

SEQ ID NO: 479309 - DNA, 15 bp, Homo sapiens
attgcagtttgcaaa

SEQ ID NO: 479310 - DNA, 15 bp, Homo sapiens
ttgcagtttgcaaat

SEQ ID NO: 479311 - DNA, 15 bp, Homo sapiens
tgcagtttgcaaatc

SEQ ID NO: 479312 - DNA, 15 bp, Homo sapiens
gcagtttgcaaatct

SEQ ID NO: 479313 - DNA, 15 bp, Homo sapiens
cagtttgcaaatctg

SEQ ID NO: 479314 - DNA, 15 bp, Homo sapiens
agtttgcaaatctga

SEQ ID NO: 479315 - DNA, 15 bp, Homo sapiens
gtttgcaaatctgaa

SEQ ID NO: 479316 - DNA, 15 bp, Homo sapiens
tttgcaaatctgaaa

SEQ ID NO: 479317 - DNA, 15 bp, Homo sapiens
ttgcaaatctgaaac

SEQ ID NO: 479318 - DNA, 15 bp, Homo sapiens
tgcaaatctgaaacc

SEQ ID NO: 479319 - DNA, 15 bp, Homo sapiens
gcaaatctgaaacct

SEQ ID NO: 479320 - DNA, 15 bp, Homo sapiens
caaatctgaaaccta

SEQ ID NO: 479321 - DNA, 15 bp, Homo sapiens
aaatctgaaacctag

SEQ ID NO: 479322 - DNA, 15 bp, Homo sapiens
aatctgaaacctaga

SEQ ID NO: 479323 - DNA, 15 bp, Homo sapiens
atctgaaacctagaa

SEQ ID NO: 479324 - DNA, 15 bp, Homo sapiens
tctgaaacctagaac

SEQ ID NO: 479325 - DNA, 15 bp, Homo sapiens
ctgaaacctagaaca

SEQ ID NO: 479326 - DNA, 15 bp, Homo sapiens
tgaaacctagaacag

SEQ ID NO: 479327 - DNA, 15 bp, Homo sapiens
gaaacctagaacaga

SEQ ID NO: 479328 - DNA, 15 bp, Homo sapiens
aaacctagaacagaa

SEQ ID NO: 479329 - DNA, 15 bp, Homo sapiens
aacctagaacagaac

SEQ ID NO: 479330 - DNA, 15 bp, Homo sapiens
acctagaacagaaca

SEQ ID NO: 479331 - DNA, 15 bp, Homo sapiens
cctagaacagaacaa

SEQ ID NO: 479332 - DNA, 15 bp, Homo sapiens
ctagaacagaacaat

SEQ ID NO: 479333 - DNA, 15 bp, Homo sapiens
tagaacagaacaatc

SEQ ID NO: 479334 - DNA, 15 bp, Homo sapiens
agaacagaacaatcc

SEQ ID NO: 479335 - DNA, 15 bp, Homo sapiens
gaacagaacaatcct

SEQ ID NO: 479336 - DNA, 15 bp, Homo sapiens
aacagaacaatcctt

SEQ ID NO: 479337 - DNA, 15 bp, Homo sapiens
acagaacaatcctta

SEQ ID NO: 479338 - DNA, 15 bp, Homo sapiens
cagaacaatccttaa

SEQ ID NO: 479339 - DNA, 15 bp, Homo sapiens
agaacaatccttaaa

SEQ ID NO: 479340 - DNA, 15 bp, Homo sapiens
gaacaatccttaaaa

SEQ ID NO: 479341 - DNA, 15 bp, Homo sapiens
aacaatccttaaaag

SEQ ID NO: 479342 - DNA, 15 bp, Homo sapiens
acaatccttaaaaga

SEQ ID NO: 479343 - DNA, 15 bp, Homo sapiens
caatccttaaaagaa

SEQ ID NO: 479344 - DNA, 15 bp, Homo sapiens
aatccttaaaagaaa

SEQ ID NO: 479345 - DNA, 15 bp, Homo sapiens
atccttaaaagaaag

SEQ ID NO: 479346 - DNA, 15 bp, Homo sapiens
tccttaaaagaaaga

SEQ ID NO: 479347 - DNA, 15 bp, Homo sapiens
ccttaaaagaaagaa

SEQ ID NO: 479348 - DNA, 15 bp, Homo sapiens
cttaaaagaaagaaa

SEQ ID NO: 479349 - DNA, 15 bp, Homo sapiens
ttaaaagaaagaaaa

SEQ ID NO: 479350 - DNA, 15 bp, Homo sapiens
taaaagaaagaaaat

SEQ ID NO: 479351 - DNA, 15 bp, Homo sapiens
aaaagaaagaaaatc

SEQ ID NO: 479352 - DNA, 15 bp, Homo sapiens
aaagaaagaaaatca

SEQ ID NO: 479353 - DNA, 15 bp, Homo sapiens
aagaaagaaaatcat

SEQ ID NO: 479354 - DNA, 15 bp, Homo sapiens
agaaagaaaatcatt

SEQ ID NO: 479355 - DNA, 15 bp, Homo sapiens
gaaagaaaatcatta

SEQ ID NO: 479356 - DNA, 15 bp, Homo sapiens
aaagaaaatcattat

SEQ ID NO: 479357 - DNA, 15 bp, Homo sapiens
aagaaaatcattatt

SEQ ID NO: 479358 - DNA, 15 bp, Homo sapiens
agaaaatcattattt

SEQ ID NO: 479359 - DNA, 15 bp, Homo sapiens
gaaaatcattatttt

SEQ ID NO: 479360 - DNA, 15 bp, Homo sapiens
aaaatcattattttt

SEQ ID NO: 479361 - DNA, 15 bp, Homo sapiens
aaatcattattttta

SEQ ID NO: 479362 - DNA, 15 bp, Homo sapiens
aatcattatttttat

SEQ ID NO: 479363 - DNA, 15 bp, Homo sapiens
atcattatttttatt

SEQ ID NO: 479364 - DNA, 15 bp, Homo sapiens
tcattatttttattt

SEQ ID NO: 479365 - DNA, 15 bp, Homo sapiens
cattatttttattta

SEQ ID NO: 479366 - DNA, 15 bp, Homo sapiens
attatttttatttat

SEQ ID NO: 479367 - DNA, 15 bp, Homo sapiens
ttatttttatttatg

SEQ ID NO: 479368 - DNA, 15 bp, Homo sapiens
tatttttatttatgt

SEQ ID NO: 479369 - DNA, 15 bp, Homo sapiens
atttttatttatgtc

SEQ ID NO: 479370 - DNA, 15 bp, Homo sapiens
tttttatttatgtct

SEQ ID NO: 479371 - DNA, 15 bp, Homo sapiens
ttttatttatgtctt

SEQ ID NO: 479372 - DNA, 15 bp, Homo sapiens
tttatttatgtcttg

SEQ ID NO: 479373 - DNA, 15 bp, Homo sapiens
ttatttatgtcttgt

SEQ ID NO: 479374 - DNA, 15 bp, Homo sapiens
tatttatgtcttgtc

SEQ ID NO: 479375 - DNA, 15 bp, Homo sapiens
atttatgtcttgtct

SEQ ID NO: 479376 - DNA, 15 bp, Homo sapiens
tttatgtcttgtcta

SEQ ID NO: 479377 - DNA, 15 bp, Homo sapiens
ttatgtcttgtctac

SEQ ID NO: 479378 - DNA, 15 bp, Homo sapiens
tatgtcttgtctact

SEQ ID NO: 479379 - DNA, 15 bp, Homo sapiens
atgtcttgtctactt

SEQ ID NO: 479380 - DNA, 15 bp, Homo sapiens
tgtcttgtctacttt

SEQ ID NO: 479381 - DNA, 15 bp, Homo sapiens
gtcttgtctactttc

SEQ ID NO: 479382 - DNA, 15 bp, Homo sapiens
tcttgtctactttca

SEQ ID NO: 479383 - DNA, 15 bp, Homo sapiens
cttgtctactttcaa

SEQ ID NO: 479384 - DNA, 15 bp, Homo sapiens
ttgtctactttcaaa

SEQ ID NO: 479385 - DNA, 15 bp, Homo sapiens
tgtctactttcaaaa

SEQ ID NO: 479386 - DNA, 15 bp, Homo sapiens
gtctactttcaaaag

SEQ ID NO: 479387 - DNA, 15 bp, Homo sapiens
tctactttcaaaagt

SEQ ID NO: 479388 - DNA, 15 bp, Homo sapiens
ctactttcaaaagtt

SEQ ID NO: 479389 - DNA, 15 bp, Homo sapiens
tactttcaaaagttc

SEQ ID NO: 479390 - DNA, 15 bp, Homo sapiens
actttcaaaagttca

SEQ ID NO: 479391 - DNA, 15 bp, Homo sapiens
ctttcaaaagttcat

SEQ ID NO: 479392 - DNA, 15 bp, Homo sapiens
tttcaaaagttcatt

SEQ ID NO: 479393 - DNA, 15 bp, Homo sapiens
ttcaaaagttcattg

SEQ ID NO: 479394 - DNA, 15 bp, Homo sapiens
tcaaaagttcattga

SEQ ID NO: 479395 - DNA, 15 bp, Homo sapiens
caaaagttcattgaa

SEQ ID NO: 479396 - DNA, 15 bp, Homo sapiens
aaaagttcattgaat

SEQ ID NO: 479397 - DNA, 15 bp, Homo sapiens
aaagttcattgaatg

SEQ ID NO: 479398 - DNA, 15 bp, Homo sapiens
aagttcattgaatga

SEQ ID NO: 479399 - DNA, 15 bp, Homo sapiens
agttcattgaatgaa

SEQ ID NO: 479400 - DNA, 15 bp, Homo sapiens
gttcattgaatgaat

SEQ ID NO: 479401 - DNA, 15 bp, Homo sapiens
ttcattgaatgaatc

SEQ ID NO: 479402 - DNA, 15 bp, Homo sapiens
tcattgaatgaatca

SEQ ID NO: 479403 - DNA, 15 bp, Homo sapiens
cattgaatgaatcac

SEQ ID NO: 479404 - DNA, 15 bp, Homo sapiens
attgaatgaatcaca

SEQ ID NO: 479405 - DNA, 15 bp, Homo sapiens
ttgaatgaatcacag

SEQ ID NO: 479406 - DNA, 15 bp, Homo sapiens
tgaatgaatcacagt

SEQ ID NO: 479407 - DNA, 15 bp, Homo sapiens
gaatgaatcacagtt

SEQ ID NO: 479408 - DNA, 15 bp, Homo sapiens
aatgaatcacagttt

SEQ ID NO: 479409 - DNA, 15 bp, Homo sapiens
atgaatcacagtttt

SEQ ID NO: 479410 - DNA, 15 bp, Homo sapiens
tgaatcacagttttt

SEQ ID NO: 479411 - DNA, 15 bp, Homo sapiens
gaatcacagtttttt

SEQ ID NO: 479412 - DNA, 15 bp, Homo sapiens
aatcacagttttttt

SEQ ID NO: 479413 - DNA, 15 bp, Homo sapiens
atcacagtttttttg

SEQ ID NO: 479414 - DNA, 15 bp, Homo sapiens
tcacagtttttttgt

SEQ ID NO: 479415 - DNA, 15 bp, Homo sapiens
cacagtttttttgtc

SEQ ID NO: 479416 - DNA, 15 bp, Homo sapiens
acagtttttttgtca

SEQ ID NO: 479417 - DNA, 15 bp, Homo sapiens
cagtttttttgtcat

SEQ ID NO: 479418 - DNA, 15 bp, Homo sapiens
agtttttttgtcatc

SEQ ID NO: 479419 - DNA, 15 bp, Homo sapiens
gtttttttgtcatct

SEQ ID NO: 479420 - DNA, 15 bp, Homo sapiens
tttttttgtcatctg

SEQ ID NO: 479421 - DNA, 15 bp, Homo sapiens
ttttttgtcatctga

SEQ ID NO: 479422 - DNA, 15 bp, Homo sapiens
tttttgtcatctgat

SEQ ID NO: 479423 - DNA, 15 bp, Homo sapiens
ttttgtcatctgata

SEQ ID NO: 479424 - DNA, 15 bp, Homo sapiens
tttgtcatctgatat

SEQ ID NO: 479425 - DNA, 15 bp, Homo sapiens
ttgtcatctgatatg

SEQ ID NO: 479426 - DNA, 15 bp, Homo sapiens
tgtcatctgatatgt

SEQ ID NO: 479427 - DNA, 15 bp, Homo sapiens
gtcatctgatatgta

SEQ ID NO: 479428 - DNA, 15 bp, Homo sapiens
tcatctgatatgtac

SEQ ID NO: 479429 - DNA, 15 bp, Homo sapiens
catctgatatgtact

SEQ ID NO: 479430 - DNA, 15 bp, Homo sapiens
atctgatatgtacta

SEQ ID NO: 479431 - DNA, 15 bp, Homo sapiens
tctgatatgtactaa

SEQ ID NO: 479432 - DNA, 15 bp, Homo sapiens
ctgatatgtactaat

SEQ ID NO: 479433 - DNA, 15 bp, Homo sapiens
tgatatgtactaatt

SEQ ID NO: 479434 - DNA, 15 bp, Homo sapiens
gatatgtactaattt

SEQ ID NO: 479435 - DNA, 15 bp, Homo sapiens
atatgtactaatttt

SEQ ID NO: 479436 - DNA, 15 bp, Homo sapiens
tatgtactaattttg

SEQ ID NO: 479437 - DNA, 15 bp, Homo sapiens
atgtactaattttgt

SEQ ID NO: 479438 - DNA, 15 bp, Homo sapiens
tgtactaattttgta

SEQ ID NO: 479439 - DNA, 15 bp, Homo sapiens
gtactaattttgtaa

SEQ ID NO: 479440 - DNA, 15 bp, Homo sapiens
tactaattttgtaat

SEQ ID NO: 479441 - DNA, 15 bp, Homo sapiens
actaattttgtaatc

SEQ ID NO: 479442 - DNA, 15 bp, Homo sapiens
ctaattttgtaatct

SEQ ID NO: 479443 - DNA, 15 bp, Homo sapiens
taattttgtaatcta

SEQ ID NO: 479444 - DNA, 15 bp, Homo sapiens
aattttgtaatctag

SEQ ID NO: 479445 - DNA, 15 bp, Homo sapiens
attttgtaatctaga

SEQ ID NO: 479446 - DNA, 15 bp, Homo sapiens
ttttgtaatctagat

SEQ ID NO: 479447 - DNA, 15 bp, Homo sapiens
tttgtaatctagata

SEQ ID NO: 479448 - DNA, 15 bp, Homo sapiens
ttgtaatctagatag

SEQ ID NO: 479449 - DNA, 15 bp, Homo sapiens
tgtaatctagatagt

SEQ ID NO: 479450 - DNA, 15 bp, Homo sapiens
gtaatctagatagtg

SEQ ID NO: 479451 - DNA, 15 bp, Homo sapiens
taatctagatagtgt

SEQ ID NO: 479452 - DNA, 15 bp, Homo sapiens
aatctagatagtgtt

SEQ ID NO: 479453 - DNA, 15 bp, Homo sapiens
atctagatagtgttt

SEQ ID NO: 479454 - DNA, 15 bp, Homo sapiens
tctagatagtgttta

SEQ ID NO: 479455 - DNA, 15 bp, Homo sapiens
ctagatagtgtttac

SEQ ID NO: 479456 - DNA, 15 bp, Homo sapiens
tagatagtgtttact

SEQ ID NO: 479457 - DNA, 15 bp, Homo sapiens
agatagtgtttacta

SEQ ID NO: 479458 - DNA, 15 bp, Homo sapiens
gatagtgtttactat

SEQ ID NO: 479459 - DNA, 15 bp, Homo sapiens
atagtgtttactatg

SEQ ID NO: 479460 - DNA, 15 bp, Homo sapiens
tagtgtttactatgt

SEQ ID NO: 479461 - DNA, 15 bp, Homo sapiens
gtgtttactatgtgt

SEQ ID NO: 479462 - DNA, 15 bp, Homo sapiens
tgtttactatgtgtg

SEQ ID NO: 479463 - DNA, 15 bp, Homo sapiens
gtttactatgtgtga

SEQ ID NO: 479464 - DNA, 15 bp, Homo sapiens
tttactatgtgtgac

SEQ ID NO: 479465 - DNA, 15 bp, Homo sapiens
ttactatgtgtgact

SEQ ID NO: 479466 - DNA, 15 bp, Homo sapiens
tactatgtgtgactt

SEQ ID NO: 479467 - DNA, 15 bp, Homo sapiens
actatgtgtgactta

SEQ ID NO: 479468 - DNA, 15 bp, Homo sapiens
ctatgtgtgacttaa

SEQ ID NO: 479469 - DNA, 15 bp, Homo sapiens
tatgtgtgacttaac

SEQ ID NO: 479470 - DNA, 15 bp, Homo sapiens
atgtgtgacttaact

SEQ ID NO: 479471 - DNA, 15 bp, Homo sapiens
tgtgtgacttaactg

SEQ ID NO: 479472 - DNA, 15 bp, Homo sapiens
gtgtgacttaactgt

SEQ ID NO: 479473 - DNA, 15 bp, Homo sapiens
tgtgacttaactgta

SEQ ID NO: 479474 - DNA, 15 bp, Homo sapiens
gtgacttaactgtag

SEQ ID NO: 479475 - DNA, 15 bp, Homo sapiens
tgacttaactgtagt

SEQ ID NO: 479476 - DNA, 15 bp, Homo sapiens
gacttaactgtagta

SEQ ID NO: 479477 - DNA, 15 bp, Homo sapiens
acttaactgtagtat

SEQ ID NO: 479478 - DNA, 15 bp, Homo sapiens
cttaactgtagtata

SEQ ID NO: 479479 - DNA, 15 bp, Homo sapiens
ttaactgtagtataa

SEQ ID NO: 479480 - DNA, 15 bp, Homo sapiens
taactgtagtataat

SEQ ID NO: 479481 - DNA, 15 bp, Homo sapiens
aactgtagtataatt

SEQ ID NO: 479482 - DNA, 15 bp, Homo sapiens
actgtagtataatta

SEQ ID NO: 479483 - DNA, 15 bp, Homo sapiens
ctgtagtataattat

SEQ ID NO: 479484 - DNA, 15 bp, Homo sapiens
tgtagtataattata

SEQ ID NO: 479485 - DNA, 15 bp, Homo sapiens
gtagtataattatat

SEQ ID NO: 479486 - DNA, 15 bp, Homo sapiens
tagtataattatatt

SEQ ID NO: 479487 - DNA, 15 bp, Homo sapiens
agtataattatattc

SEQ ID NO: 479488 - DNA, 15 bp, Homo sapiens
gtataattatattcc

SEQ ID NO: 479489 - DNA, 15 bp, Homo sapiens
tataattatattcca

SEQ ID NO: 479490 - DNA, 15 bp, Homo sapiens
ataattatattccat

SEQ ID NO: 479491 - DNA, 15 bp, Homo sapiens
taattatattccatc

SEQ ID NO: 479492 - DNA, 15 bp, Homo sapiens
aattatattccatct

SEQ ID NO: 479493 - DNA, 15 bp, Homo sapiens
attatattccatcta

SEQ ID NO: 479494 - DNA, 15 bp, Homo sapiens
ttatattccatctaa

SEQ ID NO: 479495 - DNA, 15 bp, Homo sapiens
tatattccatctaat

SEQ ID NO: 479496 - DNA, 15 bp, Homo sapiens
atattccatctaatg

SEQ ID NO: 479497 - DNA, 15 bp, Homo sapiens
tattccatctaatga

SEQ ID NO: 479498 - DNA, 15 bp, Homo sapiens
attccatctaatgat

SEQ ID NO: 479499 - DNA, 15 bp, Homo sapiens
ttccatctaatgata

SEQ ID NO: 479500 - DNA, 15 bp, Homo sapiens
tccatctaatgatat

SEQ ID NO: 479501 - DNA, 15 bp, Homo sapiens
ccatctaatgatatt

SEQ ID NO: 479502 - DNA, 15 bp, Homo sapiens
catctaatgatattt

SEQ ID NO: 479503 - DNA, 15 bp, Homo sapiens
atctaatgatatttc

SEQ ID NO: 479504 - DNA, 15 bp, Homo sapiens
tctaatgatatttcc

SEQ ID NO: 479505 - DNA, 15 bp, Homo sapiens
ctaatgatatttcct

SEQ ID NO: 479506 - DNA, 15 bp, Homo sapiens
taatgatatttcctt

SEQ ID NO: 479507 - DNA, 15 bp, Homo sapiens
aatgatatttccttg

SEQ ID NO: 479508 - DNA, 15 bp, Homo sapiens
atgatatttccttgg

SEQ ID NO: 479509 - DNA, 15 bp, Homo sapiens
tgatatttccttggt

SEQ ID NO: 479510 - DNA, 15 bp, Homo sapiens
gatatttccttggtg

SEQ ID NO: 479511 - DNA, 15 bp, Homo sapiens
atatttccttggtgc

SEQ ID NO: 479512 - DNA, 15 bp, Homo sapiens
tatttccttggtgca

SEQ ID NO: 479513 - DNA, 15 bp, Homo sapiens
atttccttggtgcaa

SEQ ID NO: 479514 - DNA, 15 bp, Homo sapiens
tttccttggtgcaaa

SEQ ID NO: 479515 - DNA, 15 bp, Homo sapiens
ttccttggtgcaaac

SEQ ID NO: 479516 - DNA, 15 bp, Homo sapiens
tccttggtgcaaacc

SEQ ID NO: 479517 - DNA, 15 bp, Homo sapiens
ccttggtgcaaacct

SEQ ID NO: 479518 - DNA, 15 bp, Homo sapiens
cttggtgcaaaccta

SEQ ID NO: 479519 - DNA, 15 bp, Homo sapiens
ttggtgcaaacctat

SEQ ID NO: 479520 - DNA, 15 bp, Homo sapiens
tggtgcaaacctatt

SEQ ID NO: 479521 - DNA, 15 bp, Homo sapiens
ggtgcaaacctatta

SEQ ID NO: 479522 - DNA, 15 bp, Homo sapiens
gtgcaaacctattat

SEQ ID NO: 479523 - DNA, 15 bp, Homo sapiens
tgcaaacctattatt

SEQ ID NO: 479524 - DNA, 15 bp, Homo sapiens
gcaaacctattattt

SEQ ID NO: 479525 - DNA, 15 bp, Homo sapiens
caaacctattatttt

SEQ ID NO: 479526 - DNA, 15 bp, Homo sapiens
aaacctattattttt

SEQ ID NO: 479527 - DNA, 15 bp, Homo sapiens
aacctattatttttg

SEQ ID NO: 479528 - DNA, 15 bp, Homo sapiens
acctattatttttgc

SEQ ID NO: 479529 - DNA, 15 bp, Homo sapiens
cctattatttttgca

SEQ ID NO: 479530 - DNA, 15 bp, Homo sapiens
ctattatttttgcaa

SEQ ID NO: 479531 - DNA, 15 bp, Homo sapiens
tattatttttgcaac

SEQ ID NO: 479532 - DNA, 15 bp, Homo sapiens
attatttttgcaaca

SEQ ID NO: 479533 - DNA, 15 bp, Homo sapiens
ttatttttgcaacat

SEQ ID NO: 479534 - DNA, 15 bp, Homo sapiens
tatttttgcaacatt

SEQ ID NO: 479535 - DNA, 15 bp, Homo sapiens
atttttgcaacattt

SEQ ID NO: 479536 - DNA, 15 bp, Homo sapiens
tttttgcaacatttt

SEQ ID NO: 479537 - DNA, 15 bp, Homo sapiens
ttttgcaacattttc

SEQ ID NO: 479538 - DNA, 15 bp, Homo sapiens
tttgcaacattttct

SEQ ID NO: 479539 - DNA, 15 bp, Homo sapiens
ttgcaacattttcta

SEQ ID NO: 479540 - DNA, 15 bp, Homo sapiens
tgcaacattttctat

SEQ ID NO: 479541 - DNA, 15 bp, Homo sapiens
gcaacattttctatt

SEQ ID NO: 479542 - DNA, 15 bp, Homo sapiens
caacattttctattt

SEQ ID NO: 479543 - DNA, 15 bp, Homo sapiens
aacattttctatttt

SEQ ID NO: 479544 - DNA, 15 bp, Homo sapiens
acattttctatttta

SEQ ID NO: 479545 - DNA, 15 bp, Homo sapiens
cattttctattttag

SEQ ID NO: 479546 - DNA, 15 bp, Homo sapiens
attttctattttagc

SEQ ID NO: 479547 - DNA, 15 bp, Homo sapiens
tttctattttagccc

SEQ ID NO: 479548 - DNA, 15 bp, Homo sapiens
ttctattttagccca

SEQ ID NO: 479549 - DNA, 15 bp, Homo sapiens
tctattttagcccaa

SEQ ID NO: 479550 - DNA, 15 bp, Homo sapiens
ctattttagcccaag

SEQ ID NO: 479551 - DNA, 15 bp, Homo sapiens
tattttagcccaaga

SEQ ID NO: 479552 - DNA, 15 bp, Homo sapiens
attttagcccaagac

SEQ ID NO: 479553 - DNA, 15 bp, Homo sapiens
ttttagcccaagaca

SEQ ID NO: 479554 - DNA, 15 bp, Homo sapiens
tttagcccaagacat

SEQ ID NO: 479555 - DNA, 15 bp, Homo sapiens
ttagcccaagacata

SEQ ID NO: 479556 - DNA, 15 bp, Homo sapiens
tagcccaagacatac

SEQ ID NO: 479557 - DNA, 15 bp, Homo sapiens
agcccaagacatacg

SEQ ID NO: 479558 - DNA, 15 bp, Homo sapiens
gcccaagacatacga

SEQ ID NO: 479559 - DNA, 15 bp, Homo sapiens
cccaagacatacgat

SEQ ID NO: 479560 - DNA, 15 bp, Homo sapiens
ccaagacatacgatt

SEQ ID NO: 479561 - DNA, 15 bp, Homo sapiens
caagacatacgattg

SEQ ID NO: 479562 - DNA, 15 bp, Homo sapiens
aagacatacgattga

SEQ ID NO: 479563 - DNA, 15 bp, Homo sapiens
agacatacgattgat

SEQ ID NO: 479564 - DNA, 15 bp, Homo sapiens
gacatacgattgatg

SEQ ID NO: 479565 - DNA, 15 bp, Homo sapiens
acatacgattgatgt

SEQ ID NO: 479566 - DNA, 15 bp, Homo sapiens
catacgattgatgtt

SEQ ID NO: 479567 - DNA, 15 bp, Homo sapiens
atacgattgatgttt

SEQ ID NO: 479568 - DNA, 15 bp, Homo sapiens
tacgattgatgttta

SEQ ID NO: 479569 - DNA, 15 bp, Homo sapiens
acgattgatgtttaa

SEQ ID NO: 479570 - DNA, 15 bp, Homo sapiens
cgattgatgtttaat

SEQ ID NO: 479571 - DNA, 15 bp, Homo sapiens
gattgatgtttaatg

SEQ ID NO: 479572 - DNA, 15 bp, Homo sapiens
attgatgtttaatgt

SEQ ID NO: 479573 - DNA, 15 bp, Homo sapiens
ttgatgtttaatgtc

SEQ ID NO: 479574 - DNA, 15 bp, Homo sapiens
tgatgtttaatgtcc

SEQ ID NO: 479575 - DNA, 15 bp, Homo sapiens
gatgtttaatgtccc

SEQ ID NO: 479576 - DNA, 15 bp, Homo sapiens
atgtttaatgtccct

SEQ ID NO: 479577 - DNA, 15 bp, Homo sapiens
tgtttaatgtccctg

SEQ ID NO: 479578 - DNA, 15 bp, Homo sapiens
gtttaatgtccctga

SEQ ID NO: 479579 - DNA, 15 bp, Homo sapiens
tttaatgtccctgat

SEQ ID NO: 479580 - DNA, 15 bp, Homo sapiens
ttaatgtccctgatc

SEQ ID NO: 479581 - DNA, 15 bp, Homo sapiens
taatgtccctgatct

SEQ ID NO: 479582 - DNA, 15 bp, Homo sapiens
aatgtccctgatctg

SEQ ID NO: 479583 - DNA, 15 bp, Homo sapiens
atgtccctgatctgg

SEQ ID NO: 479584 - DNA, 15 bp, Homo sapiens
tgtccctgatctggt

SEQ ID NO: 479585 - DNA, 15 bp, Homo sapiens
gtccctgatctggta

SEQ ID NO: 479586 - DNA, 15 bp, Homo sapiens
tccctgatctggtac

SEQ ID NO: 479587 - DNA, 15 bp, Homo sapiens
ccctgatctggtacc

SEQ ID NO: 479588 - DNA, 15 bp, Homo sapiens
cctgatctggtacct

SEQ ID NO: 479589 - DNA, 15 bp, Homo sapiens
ctgatctggtacctc

SEQ ID NO: 479590 - DNA, 15 bp, Homo sapiens
tgatctggtacctca

SEQ ID NO: 479591 - DNA, 15 bp, Homo sapiens
gatctggtacctcat

SEQ ID NO: 479592 - DNA, 15 bp, Homo sapiens
atctggtacctcatg

SEQ ID NO: 479593 - DNA, 15 bp, Homo sapiens
tctggtacctcatgt

SEQ ID NO: 479594 - DNA, 15 bp, Homo sapiens
ctggtacctcatgtt

SEQ ID NO: 479595 - DNA, 15 bp, Homo sapiens
tggtacctcatgttc

SEQ ID NO: 479596 - DNA, 15 bp, Homo sapiens
ggtacctcatgttct

SEQ ID NO: 479597 - DNA, 15 bp, Homo sapiens
gtacctcatgttcta

SEQ ID NO: 479598 - DNA, 15 bp, Homo sapiens
tacctcatgttctat

SEQ ID NO: 479599 - DNA, 15 bp, Homo sapiens
acctcatgttctatc

SEQ ID NO: 479600 - DNA, 15 bp, Homo sapiens
cctcatgttctatct

SEQ ID NO: 479601 - DNA, 15 bp, Homo sapiens
ctcatgttctatctg

SEQ ID NO: 479602 - DNA, 15 bp, Homo sapiens
tcatgttctatctgc

SEQ ID NO: 479603 - DNA, 15 bp, Homo sapiens
catgttctatctgca

SEQ ID NO: 479604 - DNA, 15 bp, Homo sapiens
atgttctatctgcat

SEQ ID NO: 479605 - DNA, 15 bp, Homo sapiens
tgttctatctgcatt

SEQ ID NO: 479606 - DNA, 15 bp, Homo sapiens
gttctatctgcattt

SEQ ID NO: 479607 - DNA, 15 bp, Homo sapiens
ttctatctgcattta

SEQ ID NO: 479608 - DNA, 15 bp, Homo sapiens
tctatctgcatttaa

SEQ ID NO: 479609 - DNA, 15 bp, Homo sapiens
ctatctgcatttaaa

SEQ ID NO: 479610 - DNA, 15 bp, Homo sapiens
tatctgcatttaaag

SEQ ID NO: 479611 - DNA, 15 bp, Homo sapiens
atctgcatttaaaga

SEQ ID NO: 479612 - DNA, 15 bp, Homo sapiens
tctgcatttaaagag

SEQ ID NO: 479613 - DNA, 15 bp, Homo sapiens
ctgcatttaaagagt

SEQ ID NO: 479614 - DNA, 15 bp, Homo sapiens
tgcatttaaagagtt

SEQ ID NO: 479615 - DNA, 15 bp, Homo sapiens
gcatttaaagagttt

SEQ ID NO: 479616 - DNA, 15 bp, Homo sapiens
catttaaagagtttg

SEQ ID NO: 479617 - DNA, 15 bp, Homo sapiens
atttaaagagtttgt

SEQ ID NO: 479618 - DNA, 15 bp, Homo sapiens
tttaaagagtttgtt

SEQ ID NO: 479619 - DNA, 15 bp, Homo sapiens
ttaaagagtttgtta

SEQ ID NO: 479620 - DNA, 15 bp, Homo sapiens
taaagagtttgttat

SEQ ID NO: 479621 - DNA, 15 bp, Homo sapiens
aaagagtttgttatt

SEQ ID NO: 479622 - DNA, 15 bp, Homo sapiens
aagagtttgttattg

SEQ ID NO: 479623 - DNA, 15 bp, Homo sapiens
agagtttgttattgg

SEQ ID NO: 479624 - DNA, 15 bp, Homo sapiens
gagtttgttattggt

SEQ ID NO: 479625 - DNA, 15 bp, Homo sapiens
agtttgttattggtt

SEQ ID NO: 479626 - DNA, 15 bp, Homo sapiens
gtttgttattggttt

SEQ ID NO: 479627 - DNA, 15 bp, Homo sapiens
tttgttattggtttt

SEQ ID NO: 479628 - DNA, 15 bp, Homo sapiens
ttgttattggttttt

SEQ ID NO: 479629 - DNA, 15 bp, Homo sapiens
tgttattggttttta

SEQ ID NO: 479630 - DNA, 15 bp, Homo sapiens
gttattggtttttac

SEQ ID NO: 479631 - DNA, 15 bp, Homo sapiens
ttattggtttttact

SEQ ID NO: 479632 - DNA, 15 bp, Homo sapiens
tattggtttttacta

SEQ ID NO: 479633 - DNA, 15 bp, Homo sapiens
attggtttttactat

SEQ ID NO: 479634 - DNA, 15 bp, Homo sapiens
ttggtttttactata

SEQ ID NO: 479635 - DNA, 15 bp, Homo sapiens
tggtttttactatat

SEQ ID NO: 479636 - DNA, 15 bp, Homo sapiens
ggtttttactatatg

SEQ ID NO: 479637 - DNA, 15 bp, Homo sapiens
gtttttactatatgt

SEQ ID NO: 479638 - DNA, 15 bp, Homo sapiens
tttttactatatgta

SEQ ID NO: 479639 - DNA, 15 bp, Homo sapiens
ttttactatatgtaa

SEQ ID NO: 479640 - DNA, 15 bp, Homo sapiens
tttactatatgtaat

SEQ ID NO: 479641 - DNA, 15 bp, Homo sapiens
ttactatatgtaatt

SEQ ID NO: 479642 - DNA, 15 bp, Homo sapiens
tactatatgtaatta

SEQ ID NO: 479643 - DNA, 15 bp, Homo sapiens
actatatgtaattaa

SEQ ID NO: 479644 - DNA, 15 bp, Homo sapiens
ctatatgtaattaag

SEQ ID NO: 479645 - DNA, 15 bp, Homo sapiens
tatatgtaattaaga

SEQ ID NO: 479646 - DNA, 15 bp, Homo sapiens
atatgtaattaagaa

SEQ ID NO: 479647 - DNA, 15 bp, Homo sapiens
tatgtaattaagaac

SEQ ID NO: 479648 - DNA, 15 bp, Homo sapiens
atgtaattaagaact

SEQ ID NO: 479649 - DNA, 15 bp, Homo sapiens
tgtaattaagaacta

SEQ ID NO: 479650 - DNA, 15 bp, Homo sapiens
gtaattaagaactag

SEQ ID NO: 479651 - DNA, 15 bp, Homo sapiens
taattaagaactaga

SEQ ID NO: 479652 - DNA, 15 bp, Homo sapiens
aattaagaactagaa

SEQ ID NO: 479653 - DNA, 15 bp, Homo sapiens
attaagaactagaat

SEQ ID NO: 479654 - DNA, 15 bp, Homo sapiens
ttaagaactagaatg

SEQ ID NO: 479655 - DNA, 15 bp, Homo sapiens
taagaactagaatgt

SEQ ID NO: 479656 - DNA, 15 bp, Homo sapiens
aagaactagaatgta

SEQ ID NO: 479657 - DNA, 15 bp, Homo sapiens
agaactagaatgtat

SEQ ID NO: 479658 - DNA, 15 bp, Homo sapiens
gaactagaatgtatc

SEQ ID NO: 479659 - DNA, 15 bp, Homo sapiens
aactagaatgtatct

SEQ ID NO: 479660 - DNA, 15 bp, Homo sapiens
actagaatgtatcta

SEQ ID NO: 479661 - DNA, 15 bp, Homo sapiens
ctagaatgtatctat

SEQ ID NO: 479662 - DNA, 15 bp, Homo sapiens
tagaatgtatctatt

SEQ ID NO: 479663 - DNA, 15 bp, Homo sapiens
agaatgtatctattt

SEQ ID NO: 479664 - DNA, 15 bp, Homo sapiens
gaatgtatctatttt

SEQ ID NO: 479665 - DNA, 15 bp, Homo sapiens
aatgtatctattttt

SEQ ID NO: 479666 - DNA, 15 bp, Homo sapiens
atgtatctattttta

SEQ ID NO: 479667 - DNA, 15 bp, Homo sapiens
tgtatctatttttat

SEQ ID NO: 479668 - DNA, 15 bp, Homo sapiens
gtatctatttttata

SEQ ID NO: 479669 - DNA, 15 bp, Homo sapiens
tatctatttttatat

SEQ ID NO: 479670 - DNA, 15 bp, Homo sapiens
atctatttttatatt

SEQ ID NO: 479671 - DNA, 15 bp, Homo sapiens
tctatttttatattc

SEQ ID NO: 479672 - DNA, 15 bp, Homo sapiens
ctatttttatattca

SEQ ID NO: 479673 - DNA, 15 bp, Homo sapiens
tatttttatattcaa

SEQ ID NO: 479674 - DNA, 15 bp, Homo sapiens
atttttatattcaac

SEQ ID NO: 479675 - DNA, 15 bp, Homo sapiens
tttttatattcaaca

SEQ ID NO: 479676 - DNA, 15 bp, Homo sapiens
ttttatattcaacat

SEQ ID NO: 479677 - DNA, 15 bp, Homo sapiens
tttatattcaacatt

SEQ ID NO: 479678 - DNA, 15 bp, Homo sapiens
ttatattcaacattt

SEQ ID NO: 479679 - DNA, 15 bp, Homo sapiens
tatattcaacattta

SEQ ID NO: 479680 - DNA, 15 bp, Homo sapiens
atattcaacatttag

SEQ ID NO: 479681 - DNA, 15 bp, Homo sapiens
tattcaacatttaga

SEQ ID NO: 479682 - DNA, 15 bp, Homo sapiens
attcaacatttagac

SEQ ID NO: 479683 - DNA, 15 bp, Homo sapiens
ttcaacatttagacc

SEQ ID NO: 479684 - DNA, 15 bp, Homo sapiens
tcaacatttagacct

SEQ ID NO: 479685 - DNA, 15 bp, Homo sapiens
caacatttagaccta

SEQ ID NO: 479686 - DNA, 15 bp, Homo sapiens
aacatttagacctaa

SEQ ID NO: 479687 - DNA, 15 bp, Homo sapiens
acatttagacctaat

SEQ ID NO: 479688 - DNA, 15 bp, Homo sapiens
catttagacctaata

SEQ ID NO: 479689 - DNA, 15 bp, Homo sapiens
atttagacctaataa

SEQ ID NO: 479690 - DNA, 15 bp, Homo sapiens
tttagacctaataat

SEQ ID NO: 479691 - DNA, 15 bp, Homo sapiens
ttagacctaataatc

SEQ ID NO: 479692 - DNA, 15 bp, Homo sapiens
tagacctaataatct

SEQ ID NO: 479693 - DNA, 15 bp, Homo sapiens
agacctaataatctg

SEQ ID NO: 479694 - DNA, 15 bp, Homo sapiens
gacctaataatctgt

SEQ ID NO: 479695 - DNA, 15 bp, Homo sapiens
acctaataatctgtg

SEQ ID NO: 479696 - DNA, 15 bp, Homo sapiens
cctaataatctgtga

SEQ ID NO: 479697 - DNA, 15 bp, Homo sapiens
ctaataatctgtgaa

SEQ ID NO: 479698 - DNA, 15 bp, Homo sapiens
taataatctgtgaaa

SEQ ID NO: 479699 - DNA, 15 bp, Homo sapiens
aataatctgtgaaaa

SEQ ID NO: 479700 - DNA, 15 bp, Homo sapiens
ataatctgtgaaaaa

SEQ ID NO: 479701 - DNA, 15 bp, Homo sapiens
taatctgtgaaaaac

SEQ ID NO: 479702 - DNA, 15 bp, Homo sapiens
aatctgtgaaaaaca

SEQ ID NO: 479703 - DNA, 15 bp, Homo sapiens
atctgtgaaaaacac

SEQ ID NO: 479704 - DNA, 15 bp, Homo sapiens
tctgtgaaaaacact

SEQ ID NO: 479705 - DNA, 15 bp, Homo sapiens
ctgtgaaaaacactt

SEQ ID NO: 479706 - DNA, 15 bp, Homo sapiens
tgtgaaaaacactta

SEQ ID NO: 479707 - DNA, 15 bp, Homo sapiens
gtgaaaaacacttaa

SEQ ID NO: 479708 - DNA, 15 bp, Homo sapiens
tgaaaaacacttaag

SEQ ID NO: 479709 - DNA, 15 bp, Homo sapiens
gaaaaacacttaaga

SEQ ID NO: 479710 - DNA, 15 bp, Homo sapiens
aaaaacacttaagac

SEQ ID NO: 479711 - DNA, 15 bp, Homo sapiens
aaaacacttaagact

SEQ ID NO: 479712 - DNA, 15 bp, Homo sapiens
aaacacttaagacta

SEQ ID NO: 479713 - DNA, 15 bp, Homo sapiens
aacacttaagactaa

SEQ ID NO: 479714 - DNA, 15 bp, Homo sapiens
acacttaagactaaa

SEQ ID NO: 479715 - DNA, 15 bp, Homo sapiens
cacttaagactaaaa

SEQ ID NO: 479716 - DNA, 15 bp, Homo sapiens
acttaagactaaaat

SEQ ID NO: 479717 - DNA, 15 bp, Homo sapiens
cttaagactaaaatt

SEQ ID NO: 479718 - DNA, 15 bp, Homo sapiens
ttaagactaaaattg

SEQ ID NO: 479719 - DNA, 15 bp, Homo sapiens
taagactaaaattgt

SEQ ID NO: 479720 - DNA, 15 bp, Homo sapiens
aagactaaaattgta

SEQ ID NO: 479721 - DNA, 15 bp, Homo sapiens
agactaaaattgtat

SEQ ID NO: 479722 - DNA, 15 bp, Homo sapiens
gactaaaattgtatg

SEQ ID NO: 479723 - DNA, 15 bp, Homo sapiens
actaaaattgtatgt

SEQ ID NO: 479724 - DNA, 15 bp, Homo sapiens
ctaaaattgtatgtt

SEQ ID NO: 479725 - DNA, 15 bp, Homo sapiens
taaaattgtatgttt

SEQ ID NO: 479726 - DNA, 15 bp, Homo sapiens
aaaattgtatgtttt

SEQ ID NO: 479727 - DNA, 15 bp, Homo sapiens
aaattgtatgtttta

SEQ ID NO: 479728 - DNA, 15 bp, Homo sapiens
aattgtatgttttat

SEQ ID NO: 479729 - DNA, 15 bp, Homo sapiens
attgtatgttttata

SEQ ID NO: 479730 - DNA, 15 bp, Homo sapiens
ttgtatgttttatat

SEQ ID NO: 479731 - DNA, 15 bp, Homo sapiens
tgtatgttttatata

SEQ ID NO: 479732 - DNA, 15 bp, Homo sapiens
gtatgttttatataa

SEQ ID NO: 479733 - DNA, 15 bp, Homo sapiens
tatgttttatataaa

SEQ ID NO: 479734 - DNA, 15 bp, Homo sapiens
atgttttatataaat

SEQ ID NO: 479735 - DNA, 15 bp, Homo sapiens
tgttttatataaatg

SEQ ID NO: 479736 - DNA, 15 bp, Homo sapiens
gttttatataaatga

SEQ ID NO: 479737 - DNA, 15 bp, Homo sapiens
ttttatataaatgat

SEQ ID NO: 479738 - DNA, 15 bp, Homo sapiens
tttatataaatgatt

SEQ ID NO: 479739 - DNA, 15 bp, Homo sapiens
ttatataaatgattg

SEQ ID NO: 479740 - DNA, 15 bp, Homo sapiens
tatataaatgattgt

SEQ ID NO: 479741 - DNA, 15 bp, Homo sapiens
atataaatgattgtt

SEQ ID NO: 479742 - DNA, 15 bp, Homo sapiens
tataaatgattgtta

SEQ ID NO: 479743 - DNA, 15 bp, Homo sapiens
ataaatgattgttaa

SEQ ID NO: 479744 - DNA, 15 bp, Homo sapiens
taaatgattgttaaa

SEQ ID NO: 479745 - DNA, 15 bp, Homo sapiens
aaatgattgttaaat

SEQ ID NO: 479746 - DNA, 15 bp, Homo sapiens
aatgattgttaaatt

SEQ ID NO: 479747 - DNA, 15 bp, Homo sapiens
atgattgttaaattc

SEQ ID NO: 479748 - DNA, 15 bp, Homo sapiens
tgattgttaaattct

SEQ ID NO: 479749 - DNA, 15 bp, Homo sapiens
gattgttaaattctt

SEQ ID NO: 479750 - DNA, 15 bp, Homo sapiens
ttgttaaattcttat

SEQ ID NO: 479751 - DNA, 15 bp, Homo sapiens
tgttaaattcttatt

SEQ ID NO: 479752 - DNA, 15 bp, Homo sapiens
gttaaattcttattt

SEQ ID NO: 479753 - DNA, 15 bp, Homo sapiens
ttaaattcttatttt

SEQ ID NO: 479754 - DNA, 15 bp, Homo sapiens
taaattcttattttt

SEQ ID NO: 479755 - DNA, 15 bp, Homo sapiens
aaattcttatttttg

SEQ ID NO: 479756 - DNA, 15 bp, Homo sapiens
aattcttatttttgt

SEQ ID NO: 479757 - DNA, 15 bp, Homo sapiens
attcttatttttgtg

SEQ ID NO: 479758 - DNA, 15 bp, Homo sapiens
ttcttatttttgtga

SEQ ID NO: 479759 - DNA, 15 bp, Homo sapiens
tcttatttttgtgaa

SEQ ID NO: 479760 - DNA, 15 bp, Homo sapiens
cttatttttgtgaaa

SEQ ID NO: 479761 - DNA, 15 bp, Homo sapiens
ttatttttgtgaaaa

SEQ ID NO: 479762 - DNA, 15 bp, Homo sapiens
tatttttgtgaaaac

SEQ ID NO: 479763 - DNA, 15 bp, Homo sapiens
atttttgtgaaaact

SEQ ID NO: 479764 - DNA, 15 bp, Homo sapiens
tttttgtgaaaactg

SEQ ID NO: 479765 - DNA, 15 bp, Homo sapiens
ttttgtgaaaactgc

SEQ ID NO: 479766 - DNA, 15 bp, Homo sapiens
tttgtgaaaactgcc

SEQ ID NO: 479767 - DNA, 15 bp, Homo sapiens
ttgtgaaaactgcct

SEQ ID NO: 479768 - DNA, 15 bp, Homo sapiens
tgtgaaaactgcctt

SEQ ID NO: 479769 - DNA, 15 bp, Homo sapiens
gtgaaaactgcctta

SEQ ID NO: 479770 - DNA, 15 bp, Homo sapiens
tgaaaactgccttaa

SEQ ID NO: 479771 - DNA, 15 bp, Homo sapiens
gaaaactgccttaac

SEQ ID NO: 479772 - DNA, 15 bp, Homo sapiens
aaaactgccttaact

SEQ ID NO: 479773 - DNA, 15 bp, Homo sapiens
aaactgccttaactc

SEQ ID NO: 479774 - DNA, 15 bp, Homo sapiens
aactgccttaactct

SEQ ID NO: 479775 - DNA, 15 bp, Homo sapiens
actgccttaactctc

SEQ ID NO: 479776 - DNA, 15 bp, Homo sapiens
ctgccttaactctct

SEQ ID NO: 479777 - DNA, 15 bp, Homo sapiens
tgccttaactctctt

SEQ ID NO: 479778 - DNA, 15 bp, Homo sapiens
gccttaactctcttc

SEQ ID NO: 479779 - DNA, 15 bp, Homo sapiens
ccttaactctcttcc

SEQ ID NO: 479780 - DNA, 15 bp, Homo sapiens
cttaactctcttcca

SEQ ID NO: 479781 - DNA, 15 bp, Homo sapiens
ttaactctcttccag

SEQ ID NO: 479782 - DNA, 15 bp, Homo sapiens
taactctcttccaga

SEQ ID NO: 479783 - DNA, 15 bp, Homo sapiens
aactctcttccagat

SEQ ID NO: 479784 - DNA, 15 bp, Homo sapiens
actctcttccagata

SEQ ID NO: 479785 - DNA, 15 bp, Homo sapiens
ctctcttccagatac

SEQ ID NO: 479786 - DNA, 15 bp, Homo sapiens
tctcttccagatacc

SEQ ID NO: 479787 - DNA, 15 bp, Homo sapiens
ctcttccagatacca

SEQ ID NO: 479788 - DNA, 15 bp, Homo sapiens
tcttccagataccat

SEQ ID NO: 479789 - DNA, 15 bp, Homo sapiens
cttccagataccata

SEQ ID NO: 479790 - DNA, 15 bp, Homo sapiens
ttccagataccataa

SEQ ID NO: 479791 - DNA, 15 bp, Homo sapiens
tccagataccataat

SEQ ID NO: 479792 - DNA, 15 bp, Homo sapiens
ccagataccataatg

SEQ ID NO: 479793 - DNA, 15 bp, Homo sapiens
cagataccataatga

SEQ ID NO: 479794 - DNA, 15 bp, Homo sapiens
agataccataatgaa

SEQ ID NO: 479795 - DNA, 15 bp, Homo sapiens
gataccataatgaaa

SEQ ID NO: 479796 - DNA, 15 bp, Homo sapiens
ataccataatgaaag

SEQ ID NO: 479797 - DNA, 15 bp, Homo sapiens
taccataatgaaaga

SEQ ID NO: 479798 - DNA, 15 bp, Homo sapiens
accataatgaaagaa

SEQ ID NO: 479799 - DNA, 15 bp, Homo sapiens
ccataatgaaagaat

SEQ ID NO: 479800 - DNA, 15 bp, Homo sapiens
cataatgaaagaatg

SEQ ID NO: 479801 - DNA, 15 bp, Homo sapiens
ataatgaaagaatgc

SEQ ID NO: 479802 - DNA, 15 bp, Homo sapiens
taatgaaagaatgca

SEQ ID NO: 479803 - DNA, 15 bp, Homo sapiens
aatgaaagaatgcaa

SEQ ID NO: 479804 - DNA, 15 bp, Homo sapiens
atgaaagaatgcaat

SEQ ID NO: 479805 - DNA, 15 bp, Homo sapiens
tgaaagaatgcaatg

SEQ ID NO: 479806 - DNA, 15 bp, Homo sapiens
gaaagaatgcaatga

SEQ ID NO: 479807 - DNA, 15 bp, Homo sapiens
aaagaatgcaatgat

SEQ ID NO: 479808 - DNA, 15 bp, Homo sapiens
aagaatgcaatgata

SEQ ID NO: 479809 - DNA, 15 bp, Homo sapiens
agaatgcaatgatag

SEQ ID NO: 479810 - DNA, 15 bp, Homo sapiens
gaatgcaatgatagt

SEQ ID NO: 479811 - DNA, 15 bp, Homo sapiens
aatgcaatgatagtg

SEQ ID NO: 479812 - DNA, 15 bp, Homo sapiens
atgcaatgatagtgg

SEQ ID NO: 479813 - DNA, 15 bp, Homo sapiens
tgcaatgatagtggg

SEQ ID NO: 479814 - DNA, 15 bp, Homo sapiens
gcaatgatagtgggg

SEQ ID NO: 479815 - DNA, 15 bp, Homo sapiens
caatgatagtgggga

SEQ ID NO: 479816 - DNA, 15 bp, Homo sapiens
aatgatagtggggat

SEQ ID NO: 479817 - DNA, 15 bp, Homo sapiens
atgatagtggggatg

SEQ ID NO: 479818 - DNA, 15 bp, Homo sapiens
tgatagtggggatga

SEQ ID NO: 479819 - DNA, 15 bp, Homo sapiens
gatagtggggatgat

SEQ ID NO: 479820 - DNA, 15 bp, Homo sapiens
atagtggggatgata

SEQ ID NO: 479821 - DNA, 15 bp, Homo sapiens
tagtggggatgataa

SEQ ID NO: 479822 - DNA, 15 bp, Homo sapiens
agtggggatgataat

SEQ ID NO: 479823 - DNA, 15 bp, Homo sapiens
gtggggatgataatt

SEQ ID NO: 479824 - DNA, 15 bp, Homo sapiens
tggggatgataatta

SEQ ID NO: 479825 - DNA, 15 bp, Homo sapiens
ggggatgataattat

SEQ ID NO: 479826 - DNA, 15 bp, Homo sapiens
gggatgataattata

SEQ ID NO: 479827 - DNA, 15 bp, Homo sapiens
ggatgataattataa

SEQ ID NO: 479828 - DNA, 15 bp, Homo sapiens
gatgataattataat

SEQ ID NO: 479829 - DNA, 15 bp, Homo sapiens
atgataattataata

SEQ ID NO: 479830 - DNA, 15 bp, Homo sapiens
tgataattataataa

SEQ ID NO: 479831 - DNA, 15 bp, Homo sapiens
gataattataataat

SEQ ID NO: 479832 - DNA, 15 bp, Homo sapiens
ataattataataatg

SEQ ID NO: 479833 - DNA, 15 bp, Homo sapiens
taattataataatgt

SEQ ID NO: 479834 - DNA, 15 bp, Homo sapiens
aattataataatgtg

SEQ ID NO: 479835 - DNA, 15 bp, Homo sapiens
attataataatgtgt

SEQ ID NO: 479836 - DNA, 15 bp, Homo sapiens
ttataataatgtgtt

SEQ ID NO: 479837 - DNA, 15 bp, Homo sapiens
tataataatgtgtta

SEQ ID NO: 479838 - DNA, 15 bp, Homo sapiens
ataataatgtgttaa

SEQ ID NO: 479839 - DNA, 15 bp, Homo sapiens
taataatgtgttaaa

SEQ ID NO: 479840 - DNA, 15 bp, Homo sapiens
aataatgtgttaaac

SEQ ID NO: 479841 - DNA, 15 bp, Homo sapiens
ataatgtgttaaact

SEQ ID NO: 479842 - DNA, 15 bp, Homo sapiens
taatgtgttaaactc

SEQ ID NO: 479843 - DNA, 15 bp, Homo sapiens
aatgtgttaaactct

SEQ ID NO: 479844 - DNA, 15 bp, Homo sapiens
atgtgttaaactcta

SEQ ID NO: 479845 - DNA, 15 bp, Homo sapiens
tgtgttaaactctat

SEQ ID NO: 479846 - DNA, 15 bp, Homo sapiens
gtgttaaactctatc

SEQ ID NO: 479847 - DNA, 15 bp, Homo sapiens
tgttaaactctatca

SEQ ID NO: 479848 - DNA, 15 bp, Homo sapiens
gttaaactctatcag

SEQ ID NO: 479849 - DNA, 15 bp, Homo sapiens
ttaaactctatcagc

SEQ ID NO: 479850 - DNA, 15 bp, Homo sapiens
taaactctatcagct

SEQ ID NO: 479851 - DNA, 15 bp, Homo sapiens
aaactctatcagctt

SEQ ID NO: 479852 - DNA, 15 bp, Homo sapiens
aactctatcagcttc

SEQ ID NO: 479853 - DNA, 15 bp, Homo sapiens
actctatcagcttcc

SEQ ID NO: 479854 - DNA, 15 bp, Homo sapiens
ctctatcagcttccc

SEQ ID NO: 479855 - DNA, 15 bp, Homo sapiens
tctatcagcttcccc

SEQ ID NO: 479856 - DNA, 15 bp, Homo sapiens
ctatcagcttcccca

SEQ ID NO: 479857 - DNA, 15 bp, Homo sapiens
tatcagcttccccag

SEQ ID NO: 479858 - DNA, 15 bp, Homo sapiens
atcagcttccccaga

SEQ ID NO: 479859 - DNA, 15 bp, Homo sapiens
tcagcttccccagag

SEQ ID NO: 479860 - DNA, 15 bp, Homo sapiens
cagcttccccagaga

SEQ ID NO: 479861 - DNA, 15 bp, Homo sapiens
agcttccccagagaa

SEQ ID NO: 479862 - DNA, 15 bp, Homo sapiens
gcttccccagagaag

SEQ ID NO: 479863 - DNA, 15 bp, Homo sapiens
cttccccagagaagt

SEQ ID NO: 479864 - DNA, 15 bp, Homo sapiens
ttccccagagaagtg

SEQ ID NO: 479865 - DNA, 15 bp, Homo sapiens
tccccagagaagtga

SEQ ID NO: 479866 - DNA, 15 bp, Homo sapiens
ccccagagaagtgaa

SEQ ID NO: 479867 - DNA, 15 bp, Homo sapiens
cccagagaagtgaat

SEQ ID NO: 479868 - DNA, 15 bp, Homo sapiens
ccagagaagtgaatc

SEQ ID NO: 479869 - DNA, 15 bp, Homo sapiens
cagagaagtgaatct

SEQ ID NO: 479870 - DNA, 15 bp, Homo sapiens
agagaagtgaatcta

SEQ ID NO: 479871 - DNA, 15 bp, Homo sapiens
gagaagtgaatctat

SEQ ID NO: 479872 - DNA, 15 bp, Homo sapiens
agaagtgaatctata

SEQ ID NO: 479873 - DNA, 15 bp, Homo sapiens
gaagtgaatctatat

SEQ ID NO: 479874 - DNA, 15 bp, Homo sapiens
aagtgaatctatatg

SEQ ID NO: 479875 - DNA, 15 bp, Homo sapiens
agtgaatctatatgt

SEQ ID NO: 479876 - DNA, 15 bp, Homo sapiens
gtgaatctatatgta

SEQ ID NO: 479877 - DNA, 15 bp, Homo sapiens
tgaatctatatgtat

SEQ ID NO: 479878 - DNA, 15 bp, Homo sapiens
gaatctatatgtatg

SEQ ID NO: 479879 - DNA, 15 bp, Homo sapiens
aatctatatgtatgt

SEQ ID NO: 479880 - DNA, 15 bp, Homo sapiens
atctatatgtatgtt

SEQ ID NO: 479881 - DNA, 15 bp, Homo sapiens
tctatatgtatgttg

SEQ ID NO: 479882 - DNA, 15 bp, Homo sapiens
ctatatgtatgttga

SEQ ID NO: 479883 - DNA, 15 bp, Homo sapiens
tatatgtatgttgac

SEQ ID NO: 479884 - DNA, 15 bp, Homo sapiens
atatgtatgttgaca

SEQ ID NO: 479885 - DNA, 15 bp, Homo sapiens
tatgtatgttgacaa

SEQ ID NO: 479886 - DNA, 15 bp, Homo sapiens
atgtatgttgacaac

SEQ ID NO: 479887 - DNA, 15 bp, Homo sapiens
tgtatgttgacaaca

SEQ ID NO: 479888 - DNA, 15 bp, Homo sapiens
gtatgttgacaacaa

SEQ ID NO: 479889 - DNA, 15 bp, Homo sapiens
tatgttgacaacaaa

SEQ ID NO: 479890 - DNA, 15 bp, Homo sapiens
atgttgacaacaaaa

SEQ ID NO: 479891 - DNA, 15 bp, Homo sapiens
tgttgacaacaaaaa

SEQ ID NO: 479892 - DNA, 15 bp, Homo sapiens
gttgacaacaaaaat

SEQ ID NO: 479893 - DNA, 15 bp, Homo sapiens
ttgacaacaaaaata

SEQ ID NO: 479894 - DNA, 15 bp, Homo sapiens
tgacaacaaaaatac

SEQ ID NO: 479895 - DNA, 15 bp, Homo sapiens
gacaacaaaaataca

SEQ ID NO: 479896 - DNA, 15 bp, Homo sapiens
acaacaaaaatacat

SEQ ID NO: 479897 - DNA, 15 bp, Homo sapiens
caacaaaaatacatc

SEQ ID NO: 479898 - DNA, 15 bp, Homo sapiens
aacaaaaatacatct

SEQ ID NO: 479899 - DNA, 15 bp, Homo sapiens
acaaaaatacatctc

SEQ ID NO: 479900 - DNA, 15 bp, Homo sapiens
caaaaatacatctca

SEQ ID NO: 479901 - DNA, 15 bp, Homo sapiens
aaaaatacatctcaa

SEQ ID NO: 479902 - DNA, 15 bp, Homo sapiens
aaaatacatctcaaa

SEQ ID NO: 479903 - DNA, 15 bp, Homo sapiens
aaatacatctcaaat

SEQ ID NO: 479904 - DNA, 15 bp, Homo sapiens
aatacatctcaaatc

SEQ ID NO: 479905 - DNA, 15 bp, Homo sapiens
atacatctcaaatct

SEQ ID NO: 479906 - DNA, 15 bp, Homo sapiens
tacatctcaaatcta

SEQ ID NO: 479907 - DNA, 15 bp, Homo sapiens
acatctcaaatctaa

SEQ ID NO: 479908 - DNA, 15 bp, Homo sapiens
catctcaaatctaat

SEQ ID NO: 479909 - DNA, 15 bp, Homo sapiens
atctcaaatctaatt

SEQ ID NO: 479910 - DNA, 15 bp, Homo sapiens
tctcaaatctaattt

SEQ ID NO: 479911 - DNA, 15 bp, Homo sapiens
ctcaaatctaatttt

SEQ ID NO: 479912 - DNA, 15 bp, Homo sapiens
tcaaatctaattttg

SEQ ID NO: 479913 - DNA, 15 bp, Homo sapiens
caaatctaattttgg

SEQ ID NO: 479914 - DNA, 15 bp, Homo sapiens
aaatctaattttggc

SEQ ID NO: 479915 - DNA, 15 bp, Homo sapiens
aatctaattttggct

SEQ ID NO: 479916 - DNA, 15 bp, Homo sapiens
atctaattttggctg

SEQ ID NO: 479917 - DNA, 15 bp, Homo sapiens
tctaattttggctgg

SEQ ID NO: 479918 - DNA, 15 bp, Homo sapiens
ctaattttggctggt

SEQ ID NO: 479919 - DNA, 15 bp, Homo sapiens
taattttggctggtt

SEQ ID NO: 479920 - DNA, 15 bp, Homo sapiens
aattttggctggttt

SEQ ID NO: 479921 - DNA, 15 bp, Homo sapiens
attttggctggtttc

SEQ ID NO: 479922 - DNA, 15 bp, Homo sapiens
ttttggctggtttca

SEQ ID NO: 479923 - DNA, 15 bp, Homo sapiens
tttggctggtttcac

SEQ ID NO: 479924 - DNA, 15 bp, Homo sapiens
ttggctggtttcact

SEQ ID NO: 479925 - DNA, 15 bp, Homo sapiens
tggctggtttcacta

SEQ ID NO: 479926 - DNA, 15 bp, Homo sapiens
ggctggtttcactat

SEQ ID NO: 479927 - DNA, 15 bp, Homo sapiens
gctggtttcactatg

SEQ ID NO: 479928 - DNA, 15 bp, Homo sapiens
ctggtttcactatgg

SEQ ID NO: 479929 - DNA, 15 bp, Homo sapiens
tggtttcactatgga

SEQ ID NO: 479930 - DNA, 15 bp, Homo sapiens
ggtttcactatggat

SEQ ID NO: 479931 - DNA, 15 bp, Homo sapiens
gtttcactatggata

SEQ ID NO: 479932 - DNA, 15 bp, Homo sapiens
tttcactatggatag

SEQ ID NO: 479933 - DNA, 15 bp, Homo sapiens
ttcactatggatagt

SEQ ID NO: 479934 - DNA, 15 bp, Homo sapiens
tcactatggatagtc

SEQ ID NO: 479935 - DNA, 15 bp, Homo sapiens
cactatggatagtca

SEQ ID NO: 479936 - DNA, 15 bp, Homo sapiens
actatggatagtcag

SEQ ID NO: 479937 - DNA, 15 bp, Homo sapiens
ctatggatagtcagt

SEQ ID NO: 479938 - DNA, 15 bp, Homo sapiens
tatggatagtcagtc

SEQ ID NO: 479939 - DNA, 15 bp, Homo sapiens
atggatagtcagtct

SEQ ID NO: 479940 - DNA, 15 bp, Homo sapiens
tggatagtcagtctc

SEQ ID NO: 479941 - DNA, 15 bp, Homo sapiens
ggatagtcagtctcc

SEQ ID NO: 479942 - DNA, 15 bp, Homo sapiens
gatagtcagtctcca

SEQ ID NO: 479943 - DNA, 15 bp, Homo sapiens
atagtcagtctccaa

SEQ ID NO: 479944 - DNA, 15 bp, Homo sapiens
tagtcagtctccaaa

SEQ ID NO: 479945 - DNA, 15 bp, Homo sapiens
agtcagtctccaaat

SEQ ID NO: 479946 - DNA, 15 bp, Homo sapiens
gtcagtctccaaatc

SEQ ID NO: 479947 - DNA, 15 bp, Homo sapiens
tcagtctccaaatct

SEQ ID NO: 479948 - DNA, 15 bp, Homo sapiens
cagtctccaaatctt

SEQ ID NO: 479949 - DNA, 15 bp, Homo sapiens
agtctccaaatcttt

SEQ ID NO: 479950 - DNA, 15 bp, Homo sapiens
gtctccaaatcttta

SEQ ID NO: 479951 - DNA, 15 bp, Homo sapiens
tctccaaatctttaa

SEQ ID NO: 479952 - DNA, 15 bp, Homo sapiens
ctccaaatctttaaa

SEQ ID NO: 479953 - DNA, 15 bp, Homo sapiens
tccaaatctttaaaa

SEQ ID NO: 479954 - DNA, 15 bp, Homo sapiens
ccaaatctttaaaac

SEQ ID NO: 479955 - DNA, 15 bp, Homo sapiens
caaatctttaaaaca

SEQ ID NO: 479956 - DNA, 15 bp, Homo sapiens
aaatctttaaaacaa

SEQ ID NO: 479957 - DNA, 15 bp, Homo sapiens
aatctttaaaacaaa

SEQ ID NO: 479958 - DNA, 15 bp, Homo sapiens
atctttaaaacaaaa

SEQ ID NO: 479959 - DNA, 15 bp, Homo sapiens
tctttaaaacaaaaa

SEQ ID NO: 479960 - DNA, 15 bp, Homo sapiens
ctttaaaacaaaaat

SEQ ID NO: 479961 - DNA, 15 bp, Homo sapiens
tttaaaacaaaaatt

SEQ ID NO: 479962 - DNA, 15 bp, Homo sapiens
ttaaaacaaaaattt

SEQ ID NO: 479963 - DNA, 15 bp, Homo sapiens
taaaacaaaaattta

SEQ ID NO: 479964 - DNA, 15 bp, Homo sapiens
aaaacaaaaatttac

SEQ ID NO: 479965 - DNA, 15 bp, Homo sapiens
aaacaaaaatttact

SEQ ID NO: 479966 - DNA, 15 bp, Homo sapiens
aacaaaaatttactt

SEQ ID NO: 479967 - DNA, 15 bp, Homo sapiens
acaaaaatttacttg

SEQ ID NO: 479968 - DNA, 15 bp, Homo sapiens
caaaaatttacttgg

SEQ ID NO: 479969 - DNA, 15 bp, Homo sapiens
aaaaatttacttggt

SEQ ID NO: 479970 - DNA, 15 bp, Homo sapiens
aaaatttacttggta

SEQ ID NO: 479971 - DNA, 15 bp, Homo sapiens
aaatttacttggtat

SEQ ID NO: 479972 - DNA, 15 bp, Homo sapiens
aatttacttggtatt

SEQ ID NO: 479973 - DNA, 15 bp, Homo sapiens
atttacttggtatta

SEQ ID NO: 479974 - DNA, 15 bp, Homo sapiens
tttacttggtattaa

SEQ ID NO: 479975 - DNA, 15 bp, Homo sapiens
ttacttggtattaat

SEQ ID NO: 479976 - DNA, 15 bp, Homo sapiens
tacttggtattaata

SEQ ID NO: 479977 - DNA, 15 bp, Homo sapiens
acttggtattaatat

SEQ ID NO: 479978 - DNA, 15 bp, Homo sapiens
cttggtattaatatt

SEQ ID NO: 479979 - DNA, 15 bp, Homo sapiens
ttggtattaatatta

SEQ ID NO: 479980 - DNA, 15 bp, Homo sapiens
tggtattaatattaa

SEQ ID NO: 479981 - DNA, 15 bp, Homo sapiens
ggtattaatattaag

SEQ ID NO: 479982 - DNA, 15 bp, Homo sapiens
gtattaatattaagc

SEQ ID NO: 479983 - DNA, 15 bp, Homo sapiens
tattaatattaagca

SEQ ID NO: 479984 - DNA, 15 bp, Homo sapiens
attaatattaagcac

SEQ ID NO: 479985 - DNA, 15 bp, Homo sapiens
ttaatattaagcact

SEQ ID NO: 479986 - DNA, 15 bp, Homo sapiens
taatattaagcactg

SEQ ID NO: 479987 - DNA, 15 bp, Homo sapiens
aatattaagcactga

SEQ ID NO: 479988 - DNA, 15 bp, Homo sapiens
atattaagcactgaa

SEQ ID NO: 479989 - DNA, 15 bp, Homo sapiens
tattaagcactgaag

SEQ ID NO: 479990 - DNA, 15 bp, Homo sapiens
attaagcactgaagt

SEQ ID NO: 479991 - DNA, 15 bp, Homo sapiens
ttaagcactgaagtt

SEQ ID NO: 479992 - DNA, 15 bp, Homo sapiens
taagcactgaagtta

SEQ ID NO: 479993 - DNA, 15 bp, Homo sapiens
aagcactgaagttaa

SEQ ID NO: 479994 - DNA, 15 bp, Homo sapiens
agcactgaagttaat

SEQ ID NO: 479995 - DNA, 15 bp, Homo sapiens
gcactgaagttaatc

SEQ ID NO: 479996 - DNA, 15 bp, Homo sapiens
cactgaagttaatcc

SEQ ID NO: 479997 - DNA, 15 bp, Homo sapiens
actgaagttaatcca

SEQ ID NO: 479998 - DNA, 15 bp, Homo sapiens
ctgaagttaatccat

SEQ ID NO: 479999 - DNA, 15 bp, Homo sapiens
tgaagttaatccatg

SEQ ID NO: 480000 - DNA, 15 bp, Homo sapiens
gaagttaatccatga

SEQ ID NO: 480001 - DNA, 15 bp, Homo sapiens
aagttaatccatgag

SEQ ID NO: 480002 - DNA, 15 bp, Homo sapiens
agttaatccatgagg

SEQ ID NO: 480003 - DNA, 15 bp, Homo sapiens
gttaatccatgaggt

SEQ ID NO: 480004 - DNA, 15 bp, Homo sapiens
ttaatccatgaggtc

SEQ ID NO: 480005 - DNA, 15 bp, Homo sapiens
taatccatgaggtca

SEQ ID NO: 480006 - DNA, 15 bp, Homo sapiens
aatccatgaggtcag

SEQ ID NO: 480007 - DNA, 15 bp, Homo sapiens
atccatgaggtcagg

SEQ ID NO: 480008 - DNA, 15 bp, Homo sapiens
tccatgaggtcaggt

SEQ ID NO: 480009 - DNA, 15 bp, Homo sapiens
ccatgaggtcaggtg

SEQ ID NO: 480010 - DNA, 15 bp, Homo sapiens
catgaggtcaggtgc

SEQ ID NO: 480011 - DNA, 15 bp, Homo sapiens
atgaggtcaggtgct

SEQ ID NO: 480012 - DNA, 15 bp, Homo sapiens
tgaggtcaggtgctg

SEQ ID NO: 480013 - DNA, 15 bp, Homo sapiens
gaggtcaggtgctgt

SEQ ID NO: 480014 - DNA, 15 bp, Homo sapiens
aggtcaggtgctgta

SEQ ID NO: 480015 - DNA, 15 bp, Homo sapiens
ggtcaggtgctgtag

SEQ ID NO: 480016 - DNA, 15 bp, Homo sapiens
gtcaggtgctgtagt

SEQ ID NO: 480017 - DNA, 15 bp, Homo sapiens
tcaggtgctgtagta

SEQ ID NO: 480018 - DNA, 15 bp, Homo sapiens
caggtgctgtagtaa

SEQ ID NO: 480019 - DNA, 15 bp, Homo sapiens
aggtgctgtagtaaa

SEQ ID NO: 480020 - DNA, 15 bp, Homo sapiens
ggtgctgtagtaaat

SEQ ID NO: 480021 - DNA, 15 bp, Homo sapiens
gtgctgtagtaaatg

SEQ ID NO: 480022 - DNA, 15 bp, Homo sapiens
tgctgtagtaaatgt

SEQ ID NO: 480023 - DNA, 15 bp, Homo sapiens
gctgtagtaaatgtt

SEQ ID NO: 480024 - DNA, 15 bp, Homo sapiens
ctgtagtaaatgttc

SEQ ID NO: 480025 - DNA, 15 bp, Homo sapiens
tgtagtaaatgttct

SEQ ID NO: 480026 - DNA, 15 bp, Homo sapiens
gtagtaaatgttctg

SEQ ID NO: 480027 - DNA, 15 bp, Homo sapiens
tagtaaatgttctga

SEQ ID NO: 480028 - DNA, 15 bp, Homo sapiens
agtaaatgttctgag

SEQ ID NO: 480029 - DNA, 15 bp, Homo sapiens
gtaaatgttctgagg

SEQ ID NO: 480030 - DNA, 15 bp, Homo sapiens
taaatgttctgaggg

SEQ ID NO: 480031 - DNA, 15 bp, Homo sapiens
aaatgttctgagggc

SEQ ID NO: 480032 - DNA, 15 bp, Homo sapiens
aatgttctgagggca

SEQ ID NO: 480033 - DNA, 15 bp, Homo sapiens
atgttctgagggcat

SEQ ID NO: 480034 - DNA, 15 bp, Homo sapiens
tgttctgagggcata

SEQ ID NO: 480035 - DNA, 15 bp, Homo sapiens
gttctgagggcataa

SEQ ID NO: 480036 - DNA, 15 bp, Homo sapiens
ttctgagggcataat

SEQ ID NO: 480037 - DNA, 15 bp, Homo sapiens
tctgagggcataatg

SEQ ID NO: 480038 - DNA, 15 bp, Homo sapiens
ctgagggcataatgg

SEQ ID NO: 480039 - DNA, 15 bp, Homo sapiens
tgagggcataatggt

SEQ ID NO: 480040 - DNA, 15 bp, Homo sapiens
gagggcataatggtg

SEQ ID NO: 480041 - DNA, 15 bp, Homo sapiens
agggcataatggtgg

SEQ ID NO: 480042 - DNA, 15 bp, Homo sapiens
gggcataatggtggc

SEQ ID NO: 480043 - DNA, 15 bp, Homo sapiens
ggcataatggtggct

SEQ ID NO: 480044 - DNA, 15 bp, Homo sapiens
gcataatggtggctt

SEQ ID NO: 480045 - DNA, 15 bp, Homo sapiens
cataatggtggcttg

SEQ ID NO: 480046 - DNA, 15 bp, Homo sapiens
ataatggtggcttgt

SEQ ID NO: 480047 - DNA, 15 bp, Homo sapiens
taatggtggcttgtg

SEQ ID NO: 480048 - DNA, 15 bp, Homo sapiens
aatggtggcttgtga

SEQ ID NO: 480049 - DNA, 15 bp, Homo sapiens
atggtggcttgtgat

SEQ ID NO: 480050 - DNA, 15 bp, Homo sapiens
tggtggcttgtgatc

SEQ ID NO: 480051 - DNA, 15 bp, Homo sapiens
ggtggcttgtgatct

SEQ ID NO: 480052 - DNA, 15 bp, Homo sapiens
gtggcttgtgatctt

SEQ ID NO: 480053 - DNA, 15 bp, Homo sapiens
tggcttgtgatcttg

SEQ ID NO: 480054 - DNA, 15 bp, Homo sapiens
ggcttgtgatcttgg

SEQ ID NO: 480055 - DNA, 15 bp, Homo sapiens
gcttgtgatcttgga

SEQ ID NO: 480056 - DNA, 15 bp, Homo sapiens
cttgtgatcttggag

SEQ ID NO: 480057 - DNA, 15 bp, Homo sapiens
ttgtgatcttggagg

SEQ ID NO: 480058 - DNA, 15 bp, Homo sapiens
tgtgatcttggagga

SEQ ID NO: 480059 - DNA, 15 bp, Homo sapiens
gtgatcttggaggaa

SEQ ID NO: 480060 - DNA, 15 bp, Homo sapiens
tgatcttggaggaac

SEQ ID NO: 480061 - DNA, 15 bp, Homo sapiens
gatcttggaggaact

SEQ ID NO: 480062 - DNA, 15 bp, Homo sapiens
atcttggaggaactc

SEQ ID NO: 480063 - DNA, 15 bp, Homo sapiens
tcttggaggaactct

SEQ ID NO: 480064 - DNA, 15 bp, Homo sapiens
cttggaggaactcta

SEQ ID NO: 480065 - DNA, 15 bp, Homo sapiens
ttggaggaactctac

SEQ ID NO: 480066 - DNA, 15 bp, Homo sapiens
tggaggaactctacg

SEQ ID NO: 480067 - DNA, 15 bp, Homo sapiens
ggaggaactctacgc

SEQ ID NO: 480068 - DNA, 15 bp, Homo sapiens
gaggaactctacgcc

SEQ ID NO: 480069 - DNA, 15 bp, Homo sapiens
aggaactctacgcca

SEQ ID NO: 480070 - DNA, 15 bp, Homo sapiens
ggaactctacgccag

SEQ ID NO: 480071 - DNA, 15 bp, Homo sapiens
gaactctacgccagg

SEQ ID NO: 480072 - DNA, 15 bp, Homo sapiens
aactctacgccagga

SEQ ID NO: 480073 - DNA, 15 bp, Homo sapiens
actctacgccaggat

SEQ ID NO: 480074 - DNA, 15 bp, Homo sapiens
ctctacgccaggatc

SEQ ID NO: 480075 - DNA, 15 bp, Homo sapiens
tctacgccaggatct

SEQ ID NO: 480076 - DNA, 15 bp, Homo sapiens
ctacgccaggatctg

SEQ ID NO: 480077 - DNA, 15 bp, Homo sapiens
tacgccaggatctgt

SEQ ID NO: 480078 - DNA, 15 bp, Homo sapiens
acgccaggatctgtg

SEQ ID NO: 480079 - DNA, 15 bp, Homo sapiens
cgccaggatctgtgg

SEQ ID NO: 480080 - DNA, 15 bp, Homo sapiens
gccaggatctgtggt

SEQ ID NO: 480081 - DNA, 15 bp, Homo sapiens
ccaggatctgtggtc

SEQ ID NO: 480082 - DNA, 15 bp, Homo sapiens
caggatctgtggtca

SEQ ID NO: 480083 - DNA, 15 bp, Homo sapiens
aggatctgtggtcaa

SEQ ID NO: 480084 - DNA, 15 bp, Homo sapiens
ggatctgtggtcaaa

SEQ ID NO: 480085 - DNA, 15 bp, Homo sapiens
gatctgtggtcaaat

SEQ ID NO: 480086 - DNA, 15 bp, Homo sapiens
atctgtggtcaaatc

SEQ ID NO: 480087 - DNA, 15 bp, Homo sapiens
tctgtggtcaaatca

SEQ ID NO: 480088 - DNA, 15 bp, Homo sapiens
ctgtggtcaaatcat

SEQ ID NO: 480089 - DNA, 15 bp, Homo sapiens
tgtggtcaaatcatg

SEQ ID NO: 480090 - DNA, 15 bp, Homo sapiens
gtggtcaaatcatgg

SEQ ID NO: 480091 - DNA, 15 bp, Homo sapiens
tggtcaaatcatggc

SEQ ID NO: 480092 - DNA, 15 bp, Homo sapiens
ggtcaaatcatggcc

SEQ ID NO: 480093 - DNA, 15 bp, Homo sapiens
gtcaaatcatggcca

SEQ ID NO: 480094 - DNA, 15 bp, Homo sapiens
tcaaatcatggccac

SEQ ID NO: 480095 - DNA, 15 bp, Homo sapiens
caaatcatggccaca

SEQ ID NO: 480096 - DNA, 15 bp, Homo sapiens
aaatcatggccacaa

SEQ ID NO: 480097 - DNA, 15 bp, Homo sapiens
aatcatggccacaag

SEQ ID NO: 480098 - DNA, 15 bp, Homo sapiens
atcatggccacaaga

SEQ ID NO: 480099 - DNA, 15 bp, Homo sapiens
tcatggccacaagat

SEQ ID NO: 480100 - DNA, 15 bp, Homo sapiens
catggccacaagatc

SEQ ID NO: 480101 - DNA, 15 bp, Homo sapiens
atggccacaagatca

SEQ ID NO: 480102 - DNA, 15 bp, Homo sapiens
tggccacaagatcag

SEQ ID NO: 480103 - DNA, 15 bp, Homo sapiens
ggccacaagatcagc

SEQ ID NO: 480104 - DNA, 15 bp, Homo sapiens
gccacaagatcagcc

SEQ ID NO: 480105 - DNA, 15 bp, Homo sapiens
ccacaagatcagcca

SEQ ID NO: 480106 - DNA, 15 bp, Homo sapiens
cacaagatcagccac

SEQ ID NO: 480107 - DNA, 15 bp, Homo sapiens
acaagatcagccaca

SEQ ID NO: 480108 - DNA, 15 bp, Homo sapiens
caagatcagccacat

SEQ ID NO: 480109 - DNA, 15 bp, Homo sapiens
aagatcagccacata

SEQ ID NO: 480110 - DNA, 15 bp, Homo sapiens
agatcagccacatag

SEQ ID NO: 480111 - DNA, 15 bp, Homo sapiens
gatcagccacatagc

SEQ ID NO: 480112 - DNA, 15 bp, Homo sapiens
atcagccacatagct

SEQ ID NO: 480113 - DNA, 15 bp, Homo sapiens
tcagccacatagctt

SEQ ID NO: 480114 - DNA, 15 bp, Homo sapiens
cagccacatagctta

SEQ ID NO: 480115 - DNA, 15 bp, Homo sapiens
agccacatagcttaa

SEQ ID NO: 480116 - DNA, 15 bp, Homo sapiens
gccacatagcttaaa

SEQ ID NO: 480117 - DNA, 15 bp, Homo sapiens
ccacatagcttaaag

SEQ ID NO: 480118 - DNA, 15 bp, Homo sapiens
cacatagcttaaagg

SEQ ID NO: 480119 - DNA, 15 bp, Homo sapiens
acatagcttaaaggg

SEQ ID NO: 480120 - DNA, 15 bp, Homo sapiens
catagcttaaaggga

SEQ ID NO: 480121 - DNA, 15 bp, Homo sapiens
atagcttaaagggat

SEQ ID NO: 480122 - DNA, 15 bp, Homo sapiens
tagcttaaagggatc

SEQ ID NO: 480123 - DNA, 15 bp, Homo sapiens
agcttaaagggatcc

SEQ ID NO: 480124 - DNA, 15 bp, Homo sapiens
gcttaaagggatcca

SEQ ID NO: 480125 - DNA, 15 bp, Homo sapiens
cttaaagggatccaa

SEQ ID NO: 480126 - DNA, 15 bp, Homo sapiens
ttaaagggatccaag

SEQ ID NO: 480127 - DNA, 15 bp, Homo sapiens
taaagggatccaagt

SEQ ID NO: 480128 - DNA, 15 bp, Homo sapiens
aaagggatccaagtt

SEQ ID NO: 480129 - DNA, 15 bp, Homo sapiens
aagggatccaagttt

SEQ ID NO: 480130 - DNA, 15 bp, Homo sapiens
agggatccaagtttt

SEQ ID NO: 480131 - DNA, 15 bp, Homo sapiens
gggatccaagttttc

SEQ ID NO: 480132 - DNA, 15 bp, Homo sapiens
ggatccaagttttct

SEQ ID NO: 480133 - DNA, 15 bp, Homo sapiens
gatccaagttttctt

SEQ ID NO: 480134 - DNA, 15 bp, Homo sapiens
atccaagttttcttt

SEQ ID NO: 480135 - DNA, 15 bp, Homo sapiens
tccaagttttctttt

SEQ ID NO: 480136 - DNA, 15 bp, Homo sapiens
ccaagttttctttta

SEQ ID NO: 480137 - DNA, 15 bp, Homo sapiens
caagttttcttttaa

SEQ ID NO: 480138 - DNA, 15 bp, Homo sapiens
aagttttcttttaat

SEQ ID NO: 480139 - DNA, 15 bp, Homo sapiens
agttttcttttaatt

SEQ ID NO: 480140 - DNA, 15 bp, Homo sapiens
gttttcttttaattc

SEQ ID NO: 480141 - DNA, 15 bp, Homo sapiens
ttttcttttaattct

SEQ ID NO: 480142 - DNA, 15 bp, Homo sapiens
tttcttttaattctt

SEQ ID NO: 480143 - DNA, 15 bp, Homo sapiens
ttcttttaattcttg

SEQ ID NO: 480144 - DNA, 15 bp, Homo sapiens
tcttttaattcttgt

SEQ ID NO: 480145 - DNA, 15 bp, Homo sapiens
cttttaattcttgtt

SEQ ID NO: 480146 - DNA, 15 bp, Homo sapiens
ttttaattcttgttg

SEQ ID NO: 480147 - DNA, 15 bp, Homo sapiens
tttaattcttgttgt

SEQ ID NO: 480148 - DNA, 15 bp, Homo sapiens
ttaattcttgttgtc

SEQ ID NO: 480149 - DNA, 15 bp, Homo sapiens
taattcttgttgtcc

SEQ ID NO: 480150 - DNA, 15 bp, Homo sapiens
aattcttgttgtcct

SEQ ID NO: 480151 - DNA, 15 bp, Homo sapiens
attcttgttgtcctt

SEQ ID NO: 480152 - DNA, 15 bp, Homo sapiens
ttcttgttgtcctta

SEQ ID NO: 480153 - DNA, 15 bp, Homo sapiens
tcttgttgtccttat

SEQ ID NO: 480154 - DNA, 15 bp, Homo sapiens
cttgttgtccttata

SEQ ID NO: 480155 - DNA, 15 bp, Homo sapiens
ttgttgtccttatat

SEQ ID NO: 480156 - DNA, 15 bp, Homo sapiens
tgttgtccttatatt

SEQ ID NO: 480157 - DNA, 15 bp, Homo sapiens
gttgtccttatatta

SEQ ID NO: 480158 - DNA, 15 bp, Homo sapiens
ttgtccttatattag

SEQ ID NO: 480159 - DNA, 15 bp, Homo sapiens
tgtccttatattagt

SEQ ID NO: 480160 - DNA, 15 bp, Homo sapiens
gtccttatattagtt

SEQ ID NO: 480161 - DNA, 15 bp, Homo sapiens
tccttatattagttc

SEQ ID NO: 480162 - DNA, 15 bp, Homo sapiens
ccttatattagttct

SEQ ID NO: 480163 - DNA, 15 bp, Homo sapiens
cttatattagttctt

SEQ ID NO: 480164 - DNA, 15 bp, Homo sapiens
ttatattagttctta

SEQ ID NO: 480165 - DNA, 15 bp, Homo sapiens
tatattagttcttat

SEQ ID NO: 480166 - DNA, 15 bp, Homo sapiens
atattagttcttatt

SEQ ID NO: 480167 - DNA, 15 bp, Homo sapiens
tattagttcttattt

SEQ ID NO: 480168 - DNA, 15 bp, Homo sapiens
attagttcttatttt

SEQ ID NO: 480169 - DNA, 15 bp, Homo sapiens
ttagttcttatttta

SEQ ID NO: 480170 - DNA, 15 bp, Homo sapiens
tagttcttattttaa

SEQ ID NO: 480171 - DNA, 15 bp, Homo sapiens
agttcttattttaag

SEQ ID NO: 480172 - DNA, 15 bp, Homo sapiens
gttcttattttaagt

SEQ ID NO: 480173 - DNA, 15 bp, Homo sapiens
ttcttattttaagtc

SEQ ID NO: 480174 - DNA, 15 bp, Homo sapiens
tcttattttaagtct

SEQ ID NO: 480175 - DNA, 15 bp, Homo sapiens
cttattttaagtctt

SEQ ID NO: 480176 - DNA, 15 bp, Homo sapiens
ttattttaagtcttt

SEQ ID NO: 480177 - DNA, 15 bp, Homo sapiens
tattttaagtctttt

SEQ ID NO: 480178 - DNA, 15 bp, Homo sapiens
attttaagtcttttc

SEQ ID NO: 480179 - DNA, 15 bp, Homo sapiens
ttttaagtcttttct

SEQ ID NO: 480180 - DNA, 15 bp, Homo sapiens
tttaagtcttttctt

SEQ ID NO: 480181 - DNA, 15 bp, Homo sapiens
ttaagtcttttcttt

SEQ ID NO: 480182 - DNA, 15 bp, Homo sapiens
taagtcttttctttc

SEQ ID NO: 480183 - DNA, 15 bp, Homo sapiens
aagtcttttctttcc

SEQ ID NO: 480184 - DNA, 15 bp, Homo sapiens
agtcttttctttcca

SEQ ID NO: 480185 - DNA, 15 bp, Homo sapiens
gtcttttctttccat

SEQ ID NO: 480186 - DNA, 15 bp, Homo sapiens
tcttttctttccata

SEQ ID NO: 480187 - DNA, 15 bp, Homo sapiens
cttttctttccatat

SEQ ID NO: 480188 - DNA, 15 bp, Homo sapiens
ttttctttccatatt

SEQ ID NO: 480189 - DNA, 15 bp, Homo sapiens
tttctttccatattt

SEQ ID NO: 480190 - DNA, 15 bp, Homo sapiens
ttctttccatattta

SEQ ID NO: 480191 - DNA, 15 bp, Homo sapiens
tctttccatatttat

SEQ ID NO: 480192 - DNA, 15 bp, Homo sapiens
ctttccatatttatt

SEQ ID NO: 480193 - DNA, 15 bp, Homo sapiens
tttccatatttatta

SEQ ID NO: 480194 - DNA, 15 bp, Homo sapiens
ttccatatttattat

SEQ ID NO: 480195 - DNA, 15 bp, Homo sapiens
tccatatttattatt

SEQ ID NO: 480196 - DNA, 15 bp, Homo sapiens
ccatatttattattt

SEQ ID NO: 480197 - DNA, 15 bp, Homo sapiens
catatttattatttt

SEQ ID NO: 480198 - DNA, 15 bp, Homo sapiens
atatttattattttc

SEQ ID NO: 480199 - DNA, 15 bp, Homo sapiens
tatttattattttct

SEQ ID NO: 480200 - DNA, 15 bp, Homo sapiens
atttattattttctt

SEQ ID NO: 480201 - DNA, 15 bp, Homo sapiens
tttattattttcttt

SEQ ID NO: 480202 - DNA, 15 bp, Homo sapiens
ttattattttctttt

SEQ ID NO: 480203 - DNA, 15 bp, Homo sapiens
ttattttcttttagg

SEQ ID NO: 480204 - DNA, 15 bp, Homo sapiens
tattttcttttaggt

SEQ ID NO: 480205 - DNA, 15 bp, Homo sapiens
attttcttttaggta

SEQ ID NO: 480206 - DNA, 15 bp, Homo sapiens
ttttcttttaggtat

SEQ ID NO: 480207 - DNA, 15 bp, Homo sapiens
tttcttttaggtatg

SEQ ID NO: 480208 - DNA, 15 bp, Homo sapiens
ttcttttaggtatgt

SEQ ID NO: 480209 - DNA, 15 bp, Homo sapiens
tcttttaggtatgtt

SEQ ID NO: 480210 - DNA, 15 bp, Homo sapiens
cttttaggtatgtta

SEQ ID NO: 480211 - DNA, 15 bp, Homo sapiens
ttttaggtatgttat

SEQ ID NO: 480212 - DNA, 15 bp, Homo sapiens
tttaggtatgttatt

SEQ ID NO: 480213 - DNA, 15 bp, Homo sapiens
ttaggtatgttattg

SEQ ID NO: 480214 - DNA, 15 bp, Homo sapiens
taggtatgttattga

SEQ ID NO: 480215 - DNA, 15 bp, Homo sapiens
aggtatgttattgat

SEQ ID NO: 480216 - DNA, 15 bp, Homo sapiens
ggtatgttattgata

SEQ ID NO: 480217 - DNA, 15 bp, Homo sapiens
gtatgttattgatag

SEQ ID NO: 480218 - DNA, 15 bp, Homo sapiens
tatgttattgatagg

SEQ ID NO: 480219 - DNA, 15 bp, Homo sapiens
atgttattgataggt

SEQ ID NO: 480220 - DNA, 15 bp, Homo sapiens
tgttattgataggta

SEQ ID NO: 480221 - DNA, 15 bp, Homo sapiens
gttattgataggtat

SEQ ID NO: 480222 - DNA, 15 bp, Homo sapiens
ttattgataggtatc

SEQ ID NO: 480223 - DNA, 15 bp, Homo sapiens
tattgataggtatca

SEQ ID NO: 480224 - DNA, 15 bp, Homo sapiens
attgataggtatcat

SEQ ID NO: 480225 - DNA, 15 bp, Homo sapiens
ttgataggtatcata

SEQ ID NO: 480226 - DNA, 15 bp, Homo sapiens
tgataggtatcatag

SEQ ID NO: 480227 - DNA, 15 bp, Homo sapiens
gataggtatcataga

SEQ ID NO: 480228 - DNA, 15 bp, Homo sapiens
ataggtatcatagaa

SEQ ID NO: 480229 - DNA, 15 bp, Homo sapiens
taggtatcatagaac

SEQ ID NO: 480230 - DNA, 15 bp, Homo sapiens
aggtatcatagaact

SEQ ID NO: 480231 - DNA, 15 bp, Homo sapiens
ggtatcatagaacta

SEQ ID NO: 480232 - DNA, 15 bp, Homo sapiens
gtatcatagaactaa

SEQ ID NO: 480233 - DNA, 15 bp, Homo sapiens
tatcatagaactaat

SEQ ID NO: 480234 - DNA, 15 bp, Homo sapiens
atcatagaactaatt

SEQ ID NO: 480235 - DNA, 15 bp, Homo sapiens
tcatagaactaattt

SEQ ID NO: 480236 - DNA, 15 bp, Homo sapiens
catagaactaatttt

SEQ ID NO: 480237 - DNA, 15 bp, Homo sapiens
atagaactaattttt

SEQ ID NO: 480238 - DNA, 15 bp, Homo sapiens
tagaactaatttttt

SEQ ID NO: 480239 - DNA, 15 bp, Homo sapiens
agaactaattttttg

SEQ ID NO: 480240 - DNA, 15 bp, Homo sapiens
gaactaattttttgt

SEQ ID NO: 480241 - DNA, 15 bp, Homo sapiens
aactaattttttgtt

SEQ ID NO: 480242 - DNA, 15 bp, Homo sapiens
actaattttttgttt

SEQ ID NO: 480243 - DNA, 15 bp, Homo sapiens
ctaattttttgtttg

SEQ ID NO: 480244 - DNA, 15 bp, Homo sapiens
taattttttgtttgt

SEQ ID NO: 480245 - DNA, 15 bp, Homo sapiens
aattttttgtttgtt

SEQ ID NO: 480246 - DNA, 15 bp, Homo sapiens
attttttgtttgttt

SEQ ID NO: 480247 - DNA, 15 bp, Homo sapiens
tgtttgttttgtttg

SEQ ID NO: 480248 - DNA, 15 bp, Homo sapiens
gtttgttttgtttgt

SEQ ID NO: 480249 - DNA, 15 bp, Homo sapiens
tttgttttgtttgtt

SEQ ID NO: 480250 - DNA, 15 bp, Homo sapiens
ttgttttgtttgttg

SEQ ID NO: 480251 - DNA, 15 bp, Homo sapiens
tgttttgtttgttgt

SEQ ID NO: 480252 - DNA, 15 bp, Homo sapiens
gttttgtttgttgtt

SEQ ID NO: 480253 - DNA, 15 bp, Homo sapiens
ttttgtttgttgttt

SEQ ID NO: 480254 - DNA, 15 bp, Homo sapiens
tttgtttgttgtttt

SEQ ID NO: 480255 - DNA, 15 bp, Homo sapiens
ttgtttgttgttttg

SEQ ID NO: 480256 - DNA, 15 bp, Homo sapiens
tgtttgttgttttgt

SEQ ID NO: 480257 - DNA, 15 bp, Homo sapiens
gtttgttgttttgtt

SEQ ID NO: 480258 - DNA, 15 bp, Homo sapiens
ttgttttgtttttga

SEQ ID NO: 480259 - DNA, 15 bp, Homo sapiens
tgttttgtttttgag

SEQ ID NO: 480260 - DNA, 15 bp, Homo sapiens
gttttgtttttgaga

SEQ ID NO: 480261 - DNA, 15 bp, Homo sapiens
ttttgtttttgagac

SEQ ID NO: 480262 - DNA, 15 bp, Homo sapiens
tgtttttgagacaga

SEQ ID NO: 480263 - DNA, 15 bp, Homo sapiens
gtttttgagacagag

SEQ ID NO: 480264 - DNA, 15 bp, Homo sapiens
ctcactctgtcgccc

SEQ ID NO: 480265 - DNA, 15 bp, Homo sapiens
tcactctgtcgccca

SEQ ID NO: 480266 - DNA, 15 bp, Homo sapiens
cactctgtcgcccag

SEQ ID NO: 480267 - DNA, 15 bp, Homo sapiens
actctgtcgcccagg

SEQ ID NO: 480268 - DNA, 15 bp, Homo sapiens
cagtggcacaatctc

SEQ ID NO: 480269 - DNA, 15 bp, Homo sapiens
caatctcagctcact

SEQ ID NO: 480270 - DNA, 15 bp, Homo sapiens
ctcactgcaaccttg

SEQ ID NO: 480271 - DNA, 15 bp, Homo sapiens
tcactgcaaccttgg

SEQ ID NO: 480272 - DNA, 15 bp, Homo sapiens
cactgcaaccttggc

SEQ ID NO: 480273 - DNA, 15 bp, Homo sapiens
actgcaaccttggct

SEQ ID NO: 480274 - DNA, 15 bp, Homo sapiens
ctgcaaccttggctt

SEQ ID NO: 480275 - DNA, 15 bp, Homo sapiens
tgcaaccttggcttc

SEQ ID NO: 480276 - DNA, 15 bp, Homo sapiens
gcaaccttggcttcc

SEQ ID NO: 480277 - DNA, 15 bp, Homo sapiens
caaccttggcttccc

SEQ ID NO: 480278 - DNA, 15 bp, Homo sapiens
aaccttggcttcccg

SEQ ID NO: 480279 - DNA, 15 bp, Homo sapiens
accttggcttcccgg

SEQ ID NO: 480280 - DNA, 15 bp, Homo sapiens
ccttggcttcccggg

SEQ ID NO: 480281 - DNA, 15 bp, Homo sapiens
cttggcttcccgggt

SEQ ID NO: 480282 - DNA, 15 bp, Homo sapiens
ttggcttcccgggtt

SEQ ID NO: 480283 - DNA, 15 bp, Homo sapiens
tggcttcccgggttc

SEQ ID NO: 480284 - DNA, 15 bp, Homo sapiens
ggcttcccgggttca

SEQ ID NO: 480285 - DNA, 15 bp, Homo sapiens
gcttcccgggttcaa

SEQ ID NO: 480286 - DNA, 15 bp, Homo sapiens
cttcccgggttcaag

SEQ ID NO: 480287 - DNA, 15 bp, Homo sapiens
ttcccgggttcaagt

SEQ ID NO: 480288 - DNA, 15 bp, Homo sapiens
tgggattataggtgc

SEQ ID NO: 480289 - DNA, 15 bp, Homo sapiens
gggattataggtgcc

SEQ ID NO: 480290 - DNA, 15 bp, Homo sapiens
ggtgcccaccaccaa

SEQ ID NO: 480291 - DNA, 15 bp, Homo sapiens
gtgcccaccaccaag

SEQ ID NO: 480292 - DNA, 15 bp, Homo sapiens
tgcccaccaccaagc

SEQ ID NO: 480293 - DNA, 15 bp, Homo sapiens
gcccaccaccaagcc

SEQ ID NO: 480294 - DNA, 15 bp, Homo sapiens
cccaccaccaagccc

SEQ ID NO: 480295 - DNA, 15 bp, Homo sapiens
ccaccaccaagccca

SEQ ID NO: 480296 - DNA, 15 bp, Homo sapiens
caccaccaagcccaa

SEQ ID NO: 480297 - DNA, 15 bp, Homo sapiens
accaccaagcccaac

SEQ ID NO: 480298 - DNA, 15 bp, Homo sapiens
ccaccaagcccaact

SEQ ID NO: 480299 - DNA, 15 bp, Homo sapiens
caccaagcccaacta

SEQ ID NO: 480300 - DNA, 15 bp, Homo sapiens
accaagcccaactaa

SEQ ID NO: 480301 - DNA, 15 bp, Homo sapiens
ccaagcccaactaat

SEQ ID NO: 480302 - DNA, 15 bp, Homo sapiens
caagcccaactaatt

SEQ ID NO: 480303 - DNA, 15 bp, Homo sapiens
aagcccaactaattt

SEQ ID NO: 480304 - DNA, 15 bp, Homo sapiens
agcccaactaatttt

SEQ ID NO: 480305 - DNA, 15 bp, Homo sapiens
gcccaactaattttt

SEQ ID NO: 480306 - DNA, 15 bp, Homo sapiens
cccaactaatttttg

SEQ ID NO: 480307 - DNA, 15 bp, Homo sapiens
ccaactaatttttgt

SEQ ID NO: 480308 - DNA, 15 bp, Homo sapiens
caactaatttttgta

SEQ ID NO: 480309 - DNA, 15 bp, Homo sapiens
aactaatttttgtat

SEQ ID NO: 480310 - DNA, 15 bp, Homo sapiens
actaatttttgtatt

SEQ ID NO: 480311 - DNA, 15 bp, Homo sapiens
gtcaggctggtctca

SEQ ID NO: 480312 - DNA, 15 bp, Homo sapiens
tcaggctggtctcaa

SEQ ID NO: 480313 - DNA, 15 bp, Homo sapiens
caggctggtctcaag

SEQ ID NO: 480314 - DNA, 15 bp, Homo sapiens
aggctggtctcaagc

SEQ ID NO: 480315 - DNA, 15 bp, Homo sapiens
ggctggtctcaagct

SEQ ID NO: 480316 - DNA, 15 bp, Homo sapiens
gctggtctcaagctc

SEQ ID NO: 480317 - DNA, 15 bp, Homo sapiens
ctggtctcaagctcc

SEQ ID NO: 480318 - DNA, 15 bp, Homo sapiens
tggtctcaagctcct

SEQ ID NO: 480319 - DNA, 15 bp, Homo sapiens
ggtctcaagctcctg

SEQ ID NO: 480320 - DNA, 15 bp, Homo sapiens
gtctcaagctcctga

SEQ ID NO: 480321 - DNA, 15 bp, Homo sapiens
tctcaagctcctgac

SEQ ID NO: 480322 - DNA, 15 bp, Homo sapiens
ctcaagctcctgacc

SEQ ID NO: 480323 - DNA, 15 bp, Homo sapiens
tcaagctcctgacct

SEQ ID NO: 480324 - DNA, 15 bp, Homo sapiens
caagctcctgacctc

SEQ ID NO: 480325 - DNA, 15 bp, Homo sapiens
aagctcctgacctca

SEQ ID NO: 480326 - DNA, 15 bp, Homo sapiens
agctcctgacctcaa

SEQ ID NO: 480327 - DNA, 15 bp, Homo sapiens
gctcctgacctcaag

SEQ ID NO: 480328 - DNA, 15 bp, Homo sapiens
caagtgatctgccca

SEQ ID NO: 480329 - DNA, 15 bp, Homo sapiens
aagtgatctgcccat

SEQ ID NO: 480330 - DNA, 15 bp, Homo sapiens
agtgatctgcccatc

SEQ ID NO: 480331 - DNA, 15 bp, Homo sapiens
gtgatctgcccatct

SEQ ID NO: 480332 - DNA, 15 bp, Homo sapiens
tgatctgcccatctc

SEQ ID NO: 480333 - DNA, 15 bp, Homo sapiens
gatctgcccatctcg

SEQ ID NO: 480334 - DNA, 15 bp, Homo sapiens
atctgcccatctcga

SEQ ID NO: 480335 - DNA, 15 bp, Homo sapiens
tctgcccatctcgac

SEQ ID NO: 480336 - DNA, 15 bp, Homo sapiens
ctgcccatctcgacc

SEQ ID NO: 480337 - DNA, 15 bp, Homo sapiens
tgcccatctcgacct

SEQ ID NO: 480338 - DNA, 15 bp, Homo sapiens
gcccatctcgacctc

SEQ ID NO: 480339 - DNA, 15 bp, Homo sapiens
cccatctcgacctcc

SEQ ID NO: 480340 - DNA, 15 bp, Homo sapiens
ccatctcgacctccc

SEQ ID NO: 480341 - DNA, 15 bp, Homo sapiens
catctcgacctccca

SEQ ID NO: 480342 - DNA, 15 bp, Homo sapiens
atctcgacctcccaa

SEQ ID NO: 480343 - DNA, 15 bp, Homo sapiens
ggcgtgagccaccgt

SEQ ID NO: 480344 - DNA, 15 bp, Homo sapiens
gcgtgagccaccgtg

SEQ ID NO: 480345 - DNA, 15 bp, Homo sapiens
cgtgagccaccgtgc

SEQ ID NO: 480346 - DNA, 15 bp, Homo sapiens
ccgtgcccagccaac

SEQ ID NO: 480347 - DNA, 15 bp, Homo sapiens
cgtgcccagccaact

SEQ ID NO: 480348 - DNA, 15 bp, Homo sapiens
gtgcccagccaacta

SEQ ID NO: 480349 - DNA, 15 bp, Homo sapiens
tgcccagccaactaa

SEQ ID NO: 480350 - DNA, 15 bp, Homo sapiens
gcccagccaactaat

SEQ ID NO: 480351 - DNA, 15 bp, Homo sapiens
cccagccaactaatt

SEQ ID NO: 480352 - DNA, 15 bp, Homo sapiens
ccagccaactaattg

SEQ ID NO: 480353 - DNA, 15 bp, Homo sapiens
cagccaactaattgt

SEQ ID NO: 480354 - DNA, 15 bp, Homo sapiens
agccaactaattgtt

SEQ ID NO: 480355 - DNA, 15 bp, Homo sapiens
gccaactaattgttt

SEQ ID NO: 480356 - DNA, 15 bp, Homo sapiens
ccaactaattgtttt

SEQ ID NO: 480357 - DNA, 15 bp, Homo sapiens
caactaattgttttt

SEQ ID NO: 480358 - DNA, 15 bp, Homo sapiens
aactaattgtttttt

SEQ ID NO: 480359 - DNA, 15 bp, Homo sapiens
actaattgttttttt

SEQ ID NO: 480360 - DNA, 15 bp, Homo sapiens
ctaattgttttttta

SEQ ID NO: 480361 - DNA, 15 bp, Homo sapiens
taattgtttttttaa

SEQ ID NO: 480362 - DNA, 15 bp, Homo sapiens
aattgtttttttaac

SEQ ID NO: 480363 - DNA, 15 bp, Homo sapiens
attgtttttttaact

SEQ ID NO: 480364 - DNA, 15 bp, Homo sapiens
ttgtttttttaacta

SEQ ID NO: 480365 - DNA, 15 bp, Homo sapiens
tgtttttttaactaa

SEQ ID NO: 480366 - DNA, 15 bp, Homo sapiens
gtttttttaactaat

SEQ ID NO: 480367 - DNA, 15 bp, Homo sapiens
tttttttaactaata

SEQ ID NO: 480368 - DNA, 15 bp, Homo sapiens
ttttttaactaatat

SEQ ID NO: 480369 - DNA, 15 bp, Homo sapiens
tttttaactaatatt

SEQ ID NO: 480370 - DNA, 15 bp, Homo sapiens
ttttaactaatatta

SEQ ID NO: 480371 - DNA, 15 bp, Homo sapiens
tttaactaatattag

SEQ ID NO: 480372 - DNA, 15 bp, Homo sapiens
ttaactaatattaga

SEQ ID NO: 480373 - DNA, 15 bp, Homo sapiens
taactaatattagaa

SEQ ID NO: 480374 - DNA, 15 bp, Homo sapiens
aactaatattagaat

SEQ ID NO: 480375 - DNA, 15 bp, Homo sapiens
actaatattagaata

SEQ ID NO: 480376 - DNA, 15 bp, Homo sapiens
ctaatattagaataa

SEQ ID NO: 480377 - DNA, 15 bp, Homo sapiens
taatattagaataag

SEQ ID NO: 480378 - DNA, 15 bp, Homo sapiens
aatattagaataagt

SEQ ID NO: 480379 - DNA, 15 bp, Homo sapiens
atattagaataagtt

SEQ ID NO: 480380 - DNA, 15 bp, Homo sapiens
tattagaataagttt

SEQ ID NO: 480381 - DNA, 15 bp, Homo sapiens
attagaataagttta

SEQ ID NO: 480382 - DNA, 15 bp, Homo sapiens
ttagaataagtttac

SEQ ID NO: 480383 - DNA, 15 bp, Homo sapiens
tagaataagtttacc

SEQ ID NO: 480384 - DNA, 15 bp, Homo sapiens
agaataagtttacct

SEQ ID NO: 480385 - DNA, 15 bp, Homo sapiens
gaataagtttacctc

SEQ ID NO: 480386 - DNA, 15 bp, Homo sapiens
aataagtttacctct

SEQ ID NO: 480387 - DNA, 15 bp, Homo sapiens
ataagtttacctcta

SEQ ID NO: 480388 - DNA, 15 bp, Homo sapiens
taagtttacctctat

SEQ ID NO: 480389 - DNA, 15 bp, Homo sapiens
aagtttacctctatt

SEQ ID NO: 480390 - DNA, 15 bp, Homo sapiens
agtttacctctattt

SEQ ID NO: 480391 - DNA, 15 bp, Homo sapiens
gtttacctctatttt

SEQ ID NO: 480392 - DNA, 15 bp, Homo sapiens
tttacctctattttt

SEQ ID NO: 480393 - DNA, 15 bp, Homo sapiens
ttacctctattttta

SEQ ID NO: 480394 - DNA, 15 bp, Homo sapiens
tacctctatttttat

SEQ ID NO: 480395 - DNA, 15 bp, Homo sapiens
acctctatttttatc

SEQ ID NO: 480396 - DNA, 15 bp, Homo sapiens
cctctatttttatcg

SEQ ID NO: 480397 - DNA, 15 bp, Homo sapiens
ctctatttttatcgt

SEQ ID NO: 480398 - DNA, 15 bp, Homo sapiens
tctatttttatcgta

SEQ ID NO: 480399 - DNA, 15 bp, Homo sapiens
ctatttttatcgtaa

SEQ ID NO: 480400 - DNA, 15 bp, Homo sapiens
tatttttatcgtaac

SEQ ID NO: 480401 - DNA, 15 bp, Homo sapiens
atttttatcgtaaca

SEQ ID NO: 480402 - DNA, 15 bp, Homo sapiens
tttttatcgtaacac

SEQ ID NO: 480403 - DNA, 15 bp, Homo sapiens
ttttatcgtaacacc

SEQ ID NO: 480404 - DNA, 15 bp, Homo sapiens
tttatcgtaacacct

SEQ ID NO: 480405 - DNA, 15 bp, Homo sapiens
ttatcgtaacacctg

SEQ ID NO: 480406 - DNA, 15 bp, Homo sapiens
tatcgtaacacctga

SEQ ID NO: 480407 - DNA, 15 bp, Homo sapiens
atcgtaacacctgag

SEQ ID NO: 480408 - DNA, 15 bp, Homo sapiens
tcgtaacacctgaga

SEQ ID NO: 480409 - DNA, 15 bp, Homo sapiens
cgtaacacctgagat

SEQ ID NO: 480410 - DNA, 15 bp, Homo sapiens
gtaacacctgagatt

SEQ ID NO: 480411 - DNA, 15 bp, Homo sapiens
taacacctgagatta

SEQ ID NO: 480412 - DNA, 15 bp, Homo sapiens
aacacctgagattac

SEQ ID NO: 480413 - DNA, 15 bp, Homo sapiens
acacctgagattacc

SEQ ID NO: 480414 - DNA, 15 bp, Homo sapiens
cacctgagattacca

SEQ ID NO: 480415 - DNA, 15 bp, Homo sapiens
acctgagattaccat

SEQ ID NO: 480416 - DNA, 15 bp, Homo sapiens
cctgagattaccatc

SEQ ID NO: 480417 - DNA, 15 bp, Homo sapiens
ctgagattaccatct

SEQ ID NO: 480418 - DNA, 15 bp, Homo sapiens
tgagattaccatcta

SEQ ID NO: 480419 - DNA, 15 bp, Homo sapiens
gagattaccatctac

SEQ ID NO: 480420 - DNA, 15 bp, Homo sapiens
agattaccatctact

SEQ ID NO: 480421 - DNA, 15 bp, Homo sapiens
gattaccatctactt

SEQ ID NO: 480422 - DNA, 15 bp, Homo sapiens
attaccatctacttt

SEQ ID NO: 480423 - DNA, 15 bp, Homo sapiens
ttaccatctacttta

SEQ ID NO: 480424 - DNA, 15 bp, Homo sapiens
taccatctactttag

SEQ ID NO: 480425 - DNA, 15 bp, Homo sapiens
accatctactttagt

SEQ ID NO: 480426 - DNA, 15 bp, Homo sapiens
ccatctactttagtt

SEQ ID NO: 480427 - DNA, 15 bp, Homo sapiens
catctactttagttc

SEQ ID NO: 480428 - DNA, 15 bp, Homo sapiens
atctactttagttcc

SEQ ID NO: 480429 - DNA, 15 bp, Homo sapiens
tctactttagttcca

SEQ ID NO: 480430 - DNA, 15 bp, Homo sapiens
ctactttagttccat

SEQ ID NO: 480431 - DNA, 15 bp, Homo sapiens
tactttagttccatt

SEQ ID NO: 480432 - DNA, 15 bp, Homo sapiens
actttagttccattt

SEQ ID NO: 480433 - DNA, 15 bp, Homo sapiens
ctttagttccatttt

SEQ ID NO: 480434 - DNA, 15 bp, Homo sapiens
tttagttccattttg

SEQ ID NO: 480435 - DNA, 15 bp, Homo sapiens
ttagttccattttgc

SEQ ID NO: 480436 - DNA, 15 bp, Homo sapiens
tagttccattttgca

SEQ ID NO: 480437 - DNA, 15 bp, Homo sapiens
agttccattttgcat

SEQ ID NO: 480438 - DNA, 15 bp, Homo sapiens
gttccattttgcatt

SEQ ID NO: 480439 - DNA, 15 bp, Homo sapiens
ttccattttgcatta

SEQ ID NO: 480440 - DNA, 15 bp, Homo sapiens
tccattttgcattat

SEQ ID NO: 480441 - DNA, 15 bp, Homo sapiens
ccattttgcattatc

SEQ ID NO: 480442 - DNA, 15 bp, Homo sapiens
cattttgcattatcc

SEQ ID NO: 480443 - DNA, 15 bp, Homo sapiens
attttgcattatcct

SEQ ID NO: 480444 - DNA, 15 bp, Homo sapiens
ttttgcattatcctt

SEQ ID NO: 480445 - DNA, 15 bp, Homo sapiens
tttgcattatccttg

SEQ ID NO: 480446 - DNA, 15 bp, Homo sapiens
ttgcattatccttgc

SEQ ID NO: 480447 - DNA, 15 bp, Homo sapiens
tgcattatccttgct

SEQ ID NO: 480448 - DNA, 15 bp, Homo sapiens
gcattatccttgctc

SEQ ID NO: 480449 - DNA, 15 bp, Homo sapiens
cattatccttgctca

SEQ ID NO: 480450 - DNA, 15 bp, Homo sapiens
attatccttgctcat

SEQ ID NO: 480451 - DNA, 15 bp, Homo sapiens
ttatccttgctcatt

SEQ ID NO: 480452 - DNA, 15 bp, Homo sapiens
tatccttgctcattc

SEQ ID NO: 480453 - DNA, 15 bp, Homo sapiens
atccttgctcattct

SEQ ID NO: 480454 - DNA, 15 bp, Homo sapiens
tccttgctcattctt

SEQ ID NO: 480455 - DNA, 15 bp, Homo sapiens
ccttgctcattcttt

SEQ ID NO: 480456 - DNA, 15 bp, Homo sapiens
cttgctcattctttc

SEQ ID NO: 480457 - DNA, 15 bp, Homo sapiens
ttgctcattctttct

SEQ ID NO: 480458 - DNA, 15 bp, Homo sapiens
tgctcattctttctt

SEQ ID NO: 480459 - DNA, 15 bp, Homo sapiens
gctcattctttcttt

SEQ ID NO: 480460 - DNA, 15 bp, Homo sapiens
ctcattctttctttc

SEQ ID NO: 480461 - DNA, 15 bp, Homo sapiens
tcattctttctttca

SEQ ID NO: 480462 - DNA, 15 bp, Homo sapiens
cattctttctttcat

SEQ ID NO: 480463 - DNA, 15 bp, Homo sapiens
attctttctttcata

SEQ ID NO: 480464 - DNA, 15 bp, Homo sapiens
ttctttctttcatat

SEQ ID NO: 480465 - DNA, 15 bp, Homo sapiens
tctttctttcatatg

SEQ ID NO: 480466 - DNA, 15 bp, Homo sapiens
ctttctttcatatgc

SEQ ID NO: 480467 - DNA, 15 bp, Homo sapiens
tttctttcatatgct

SEQ ID NO: 480468 - DNA, 15 bp, Homo sapiens
ttctttcatatgcta

SEQ ID NO: 480469 - DNA, 15 bp, Homo sapiens
tctttcatatgctat

SEQ ID NO: 480470 - DNA, 15 bp, Homo sapiens
ctttcatatgctatg

SEQ ID NO: 480471 - DNA, 15 bp, Homo sapiens
tttcatatgctatgt

SEQ ID NO: 480472 - DNA, 15 bp, Homo sapiens
ttcatatgctatgtg

SEQ ID NO: 480473 - DNA, 15 bp, Homo sapiens
tcatatgctatgtgg

SEQ ID NO: 480474 - DNA, 15 bp, Homo sapiens
catatgctatgtgga

SEQ ID NO: 480475 - DNA, 15 bp, Homo sapiens
atatgctatgtggac

SEQ ID NO: 480476 - DNA, 15 bp, Homo sapiens
tatgctatgtggaca

SEQ ID NO: 480477 - DNA, 15 bp, Homo sapiens
atgctatgtggacaa

SEQ ID NO: 480478 - DNA, 15 bp, Homo sapiens
tgctatgtggacaaa

SEQ ID NO: 480479 - DNA, 15 bp, Homo sapiens
gctatgtggacaaag

SEQ ID NO: 480480 - DNA, 15 bp, Homo sapiens
ctatgtggacaaagt

SEQ ID NO: 480481 - DNA, 15 bp, Homo sapiens
tatgtggacaaagtg

SEQ ID NO: 480482 - DNA, 15 bp, Homo sapiens
atgtggacaaagtgc

SEQ ID NO: 480483 - DNA, 15 bp, Homo sapiens
tgtggacaaagtgct

SEQ ID NO: 480484 - DNA, 15 bp, Homo sapiens
gtggacaaagtgctt

SEQ ID NO: 480485 - DNA, 15 bp, Homo sapiens
tggacaaagtgcttt

SEQ ID NO: 480486 - DNA, 15 bp, Homo sapiens
ggacaaagtgctttg

SEQ ID NO: 480487 - DNA, 15 bp, Homo sapiens
gacaaagtgctttgc

SEQ ID NO: 480488 - DNA, 15 bp, Homo sapiens
acaaagtgctttgcc

SEQ ID NO: 480489 - DNA, 15 bp, Homo sapiens
caaagtgctttgcct

SEQ ID NO: 480490 - DNA, 15 bp, Homo sapiens
aaagtgctttgcctg

SEQ ID NO: 480491 - DNA, 15 bp, Homo sapiens
aagtgctttgcctgt

SEQ ID NO: 480492 - DNA, 15 bp, Homo sapiens
agtgctttgcctgta

SEQ ID NO: 480493 - DNA, 15 bp, Homo sapiens
gtgctttgcctgtac

SEQ ID NO: 480494 - DNA, 15 bp, Homo sapiens
tgctttgcctgtaca

SEQ ID NO: 480495 - DNA, 15 bp, Homo sapiens
gctttgcctgtacac

SEQ ID NO: 480496 - DNA, 15 bp, Homo sapiens
ctttgcctgtacact

SEQ ID NO: 480497 - DNA, 15 bp, Homo sapiens
tttgcctgtacactt

SEQ ID NO: 480498 - DNA, 15 bp, Homo sapiens
ttgcctgtacacttg

SEQ ID NO: 480499 - DNA, 15 bp, Homo sapiens
tgcctgtacacttga

SEQ ID NO: 480500 - DNA, 15 bp, Homo sapiens
gcctgtacacttgaa

SEQ ID NO: 480501 - DNA, 15 bp, Homo sapiens
cctgtacacttgaat

SEQ ID NO: 480502 - DNA, 15 bp, Homo sapiens
ctgtacacttgaatg

SEQ ID NO: 480503 - DNA, 15 bp, Homo sapiens
tgtacacttgaatga

SEQ ID NO: 480504 - DNA, 15 bp, Homo sapiens
gtacacttgaatgac

SEQ ID NO: 480505 - DNA, 15 bp, Homo sapiens
tacacttgaatgacc

SEQ ID NO: 480506 - DNA, 15 bp, Homo sapiens
acacttgaatgacct

SEQ ID NO: 480507 - DNA, 15 bp, Homo sapiens
cacttgaatgacctg

SEQ ID NO: 480508 - DNA, 15 bp, Homo sapiens
acttgaatgacctgc

SEQ ID NO: 480509 - DNA, 15 bp, Homo sapiens
cttgaatgacctgcc

SEQ ID NO: 480510 - DNA, 15 bp, Homo sapiens
ttgaatgacctgcct

SEQ ID NO: 480511 - DNA, 15 bp, Homo sapiens
tgaatgacctgcctg

SEQ ID NO: 480512 - DNA, 15 bp, Homo sapiens
gaatgacctgcctgg

SEQ ID NO: 480513 - DNA, 15 bp, Homo sapiens
aatgacctgcctggt

SEQ ID NO: 480514 - DNA, 15 bp, Homo sapiens
atgacctgcctggtc

SEQ ID NO: 480515 - DNA, 15 bp, Homo sapiens
tgacctgcctggtca

SEQ ID NO: 480516 - DNA, 15 bp, Homo sapiens
gacctgcctggtcat

SEQ ID NO: 480517 - DNA, 15 bp, Homo sapiens
acctgcctggtcata

SEQ ID NO: 480518 - DNA, 15 bp, Homo sapiens
cctgcctggtcatat

SEQ ID NO: 480519 - DNA, 15 bp, Homo sapiens
ctgcctggtcatatg

SEQ ID NO: 480520 - DNA, 15 bp, Homo sapiens
tgcctggtcatatgg

SEQ ID NO: 480521 - DNA, 15 bp, Homo sapiens
gcctggtcatatgga

SEQ ID NO: 480522 - DNA, 15 bp, Homo sapiens
cctggtcatatggat

SEQ ID NO: 480523 - DNA, 15 bp, Homo sapiens
ctggtcatatggatg

SEQ ID NO: 480524 - DNA, 15 bp, Homo sapiens
tggtcatatggatgg

SEQ ID NO: 480525 - DNA, 15 bp, Homo sapiens
ggtcatatggatgga

SEQ ID NO: 480526 - DNA, 15 bp, Homo sapiens
gtcatatggatggat

SEQ ID NO: 480527 - DNA, 15 bp, Homo sapiens
tcatatggatggata

SEQ ID NO: 480528 - DNA, 15 bp, Homo sapiens
catatggatggatag

SEQ ID NO: 480529 - DNA, 15 bp, Homo sapiens
atatggatggatagg

SEQ ID NO: 480530 - DNA, 15 bp, Homo sapiens
tatggatggataggt

SEQ ID NO: 480531 - DNA, 15 bp, Homo sapiens
atggatggataggtt

SEQ ID NO: 480532 - DNA, 15 bp, Homo sapiens
tggatggataggtta

SEQ ID NO: 480533 - DNA, 15 bp, Homo sapiens
ggatggataggttag

SEQ ID NO: 480534 - DNA, 15 bp, Homo sapiens
gatggataggttagg

SEQ ID NO: 480535 - DNA, 15 bp, Homo sapiens
atggataggttagga

SEQ ID NO: 480536 - DNA, 15 bp, Homo sapiens
tggataggttaggac

SEQ ID NO: 480537 - DNA, 15 bp, Homo sapiens
ggataggttaggact

SEQ ID NO: 480538 - DNA, 15 bp, Homo sapiens
gataggttaggactg

SEQ ID NO: 480539 - DNA, 15 bp, Homo sapiens
ataggttaggactgt

SEQ ID NO: 480540 - DNA, 15 bp, Homo sapiens
taggttaggactgta

SEQ ID NO: 480541 - DNA, 15 bp, Homo sapiens
aggttaggactgtag

SEQ ID NO: 480542 - DNA, 15 bp, Homo sapiens
ggttaggactgtaga

SEQ ID NO: 480543 - DNA, 15 bp, Homo sapiens
gttaggactgtagat

SEQ ID NO: 480544 - DNA, 15 bp, Homo sapiens
ttaggactgtagata

SEQ ID NO: 480545 - DNA, 15 bp, Homo sapiens
taggactgtagatat

SEQ ID NO: 480546 - DNA, 15 bp, Homo sapiens
aggactgtagatatt

SEQ ID NO: 480547 - DNA, 15 bp, Homo sapiens
ggactgtagatattg

SEQ ID NO: 480548 - DNA, 15 bp, Homo sapiens
gactgtagatattgc

SEQ ID NO: 480549 - DNA, 15 bp, Homo sapiens
actgtagatattgct

SEQ ID NO: 480550 - DNA, 15 bp, Homo sapiens
ctgtagatattgctc

SEQ ID NO: 480551 - DNA, 15 bp, Homo sapiens
tgtagatattgctcc

SEQ ID NO: 480552 - DNA, 15 bp, Homo sapiens
gtagatattgctcca

SEQ ID NO: 480553 - DNA, 15 bp, Homo sapiens
tagatattgctccat

SEQ ID NO: 480554 - DNA, 15 bp, Homo sapiens
agatattgctccatt

SEQ ID NO: 480555 - DNA, 15 bp, Homo sapiens
gatattgctccattg

SEQ ID NO: 480556 - DNA, 15 bp, Homo sapiens
atattgctccattgt

SEQ ID NO: 480557 - DNA, 15 bp, Homo sapiens
tattgctccattgtc

SEQ ID NO: 480558 - DNA, 15 bp, Homo sapiens
attgctccattgtct

SEQ ID NO: 480559 - DNA, 15 bp, Homo sapiens
ttgctccattgtctt

SEQ ID NO: 480560 - DNA, 15 bp, Homo sapiens
tgctccattgtcttt

SEQ ID NO: 480561 - DNA, 15 bp, Homo sapiens
gctccattgtctttg

SEQ ID NO: 480562 - DNA, 15 bp, Homo sapiens
ctccattgtctttgg

SEQ ID NO: 480563 - DNA, 15 bp, Homo sapiens
tccattgtctttgga

SEQ ID NO: 480564 - DNA, 15 bp, Homo sapiens
ccattgtctttggac

SEQ ID NO: 480565 - DNA, 15 bp, Homo sapiens
cattgtctttggaca

SEQ ID NO: 480566 - DNA, 15 bp, Homo sapiens
attgtctttggacat

SEQ ID NO: 480567 - DNA, 15 bp, Homo sapiens
ttgtctttggacatt

SEQ ID NO: 480568 - DNA, 15 bp, Homo sapiens
tgtctttggacattt

SEQ ID NO: 480569 - DNA, 15 bp, Homo sapiens
gtctttggacattta

SEQ ID NO: 480570 - DNA, 15 bp, Homo sapiens
tctttggacatttaa

SEQ ID NO: 480571 - DNA, 15 bp, Homo sapiens
ctttggacatttaat

SEQ ID NO: 480572 - DNA, 15 bp, Homo sapiens
tttggacatttaata

SEQ ID NO: 480573 - DNA, 15 bp, Homo sapiens
ttggacatttaatat

SEQ ID NO: 480574 - DNA, 15 bp, Homo sapiens
tggacatttaatatt

SEQ ID NO: 480575 - DNA, 15 bp, Homo sapiens
ggacatttaatatta

SEQ ID NO: 480576 - DNA, 15 bp, Homo sapiens
gacatttaatattat

SEQ ID NO: 480577 - DNA, 15 bp, Homo sapiens
acatttaatattatg

SEQ ID NO: 480578 - DNA, 15 bp, Homo sapiens
catttaatattatgg

SEQ ID NO: 480579 - DNA, 15 bp, Homo sapiens
atttaatattatgga

SEQ ID NO: 480580 - DNA, 15 bp, Homo sapiens
tttaatattatggaa

SEQ ID NO: 480581 - DNA, 15 bp, Homo sapiens
ttaatattatggaaa

SEQ ID NO: 480582 - DNA, 15 bp, Homo sapiens
taatattatggaaaa

SEQ ID NO: 480583 - DNA, 15 bp, Homo sapiens
aatattatggaaaat

SEQ ID NO: 480584 - DNA, 15 bp, Homo sapiens
atattatggaaaata

SEQ ID NO: 480585 - DNA, 15 bp, Homo sapiens
tattatggaaaatag

SEQ ID NO: 480586 - DNA, 15 bp, Homo sapiens
attatggaaaatagg

SEQ ID NO: 480587 - DNA, 15 bp, Homo sapiens
ttatggaaaatagga

SEQ ID NO: 480588 - DNA, 15 bp, Homo sapiens
tatggaaaataggaa

SEQ ID NO: 480589 - DNA, 15 bp, Homo sapiens
atggaaaataggaag

SEQ ID NO: 480590 - DNA, 15 bp, Homo sapiens
tggaaaataggaagc

SEQ ID NO: 480591 - DNA, 15 bp, Homo sapiens
ggaaaataggaagct

SEQ ID NO: 480592 - DNA, 15 bp, Homo sapiens
gaaaataggaagcta

SEQ ID NO: 480593 - DNA, 15 bp, Homo sapiens
aaaataggaagctaa

SEQ ID NO: 480594 - DNA, 15 bp, Homo sapiens
aataggaagctaaac

SEQ ID NO: 480595 - DNA, 15 bp, Homo sapiens
ataggaagctaaacc

SEQ ID NO: 480596 - DNA, 15 bp, Homo sapiens
taggaagctaaacct

SEQ ID NO: 480597 - DNA, 15 bp, Homo sapiens
aggaagctaaacctt

SEQ ID NO: 480598 - DNA, 15 bp, Homo sapiens
ggaagctaaaccttt

SEQ ID NO: 480599 - DNA, 15 bp, Homo sapiens
gaagctaaacctttt

SEQ ID NO: 480600 - DNA, 15 bp, Homo sapiens
aagctaaaccttttt

SEQ ID NO: 480601 - DNA, 15 bp, Homo sapiens
agctaaacctttttc

SEQ ID NO: 480602 - DNA, 15 bp, Homo sapiens
gctaaacctttttcc

SEQ ID NO: 480603 - DNA, 15 bp, Homo sapiens
ctaaacctttttcca

SEQ ID NO: 480604 - DNA, 15 bp, Homo sapiens
taaacctttttccac

SEQ ID NO: 480605 - DNA, 15 bp, Homo sapiens
aaacctttttccacc

SEQ ID NO: 480606 - DNA, 15 bp, Homo sapiens
aacctttttccaccg

SEQ ID NO: 480607 - DNA, 15 bp, Homo sapiens
acctttttccaccgc

SEQ ID NO: 480608 - DNA, 15 bp, Homo sapiens
cctttttccaccgct

SEQ ID NO: 480609 - DNA, 15 bp, Homo sapiens
ctttttccaccgctg

SEQ ID NO: 480610 - DNA, 15 bp, Homo sapiens
tttttccaccgctga

SEQ ID NO: 480611 - DNA, 15 bp, Homo sapiens
ttttccaccgctgaa

SEQ ID NO: 480612 - DNA, 15 bp, Homo sapiens
tttccaccgctgaac

SEQ ID NO: 480613 - DNA, 15 bp, Homo sapiens
ttccaccgctgaaca

SEQ ID NO: 480614 - DNA, 15 bp, Homo sapiens
tccaccgctgaacat

SEQ ID NO: 480615 - DNA, 15 bp, Homo sapiens
ccaccgctgaacatg

SEQ ID NO: 480616 - DNA, 15 bp, Homo sapiens
caccgctgaacatga

SEQ ID NO: 480617 - DNA, 15 bp, Homo sapiens
accgctgaacatgat

SEQ ID NO: 480618 - DNA, 15 bp, Homo sapiens
ccgctgaacatgatt

SEQ ID NO: 480619 - DNA, 15 bp, Homo sapiens
cgctgaacatgattt

SEQ ID NO: 480620 - DNA, 15 bp, Homo sapiens
gctgaacatgattta

SEQ ID NO: 480621 - DNA, 15 bp, Homo sapiens
ctgaacatgatttac

SEQ ID NO: 480622 - DNA, 15 bp, Homo sapiens
tgaacatgatttact

SEQ ID NO: 480623 - DNA, 15 bp, Homo sapiens
gaacatgatttactg

SEQ ID NO: 480624 - DNA, 15 bp, Homo sapiens
aacatgatttactgt

SEQ ID NO: 480625 - DNA, 15 bp, Homo sapiens
acatgatttactgtt

SEQ ID NO: 480626 - DNA, 15 bp, Homo sapiens
catgatttactgttt

SEQ ID NO: 480627 - DNA, 15 bp, Homo sapiens
atgatttactgtttt

SEQ ID NO: 480628 - DNA, 15 bp, Homo sapiens
tgatttactgtttta

SEQ ID NO: 480629 - DNA, 15 bp, Homo sapiens
gatttactgttttat

SEQ ID NO: 480630 - DNA, 15 bp, Homo sapiens
atttactgttttatt

SEQ ID NO: 480631 - DNA, 15 bp, Homo sapiens
tttactgttttattt

SEQ ID NO: 480632 - DNA, 15 bp, Homo sapiens
ttactgttttatttt

SEQ ID NO: 480633 - DNA, 15 bp, Homo sapiens
tactgttttattttg

SEQ ID NO: 480634 - DNA, 15 bp, Homo sapiens
actgttttattttga

SEQ ID NO: 480635 - DNA, 15 bp, Homo sapiens
ctgttttattttgat

SEQ ID NO: 480636 - DNA, 15 bp, Homo sapiens
tgttttattttgatt

SEQ ID NO: 480637 - DNA, 15 bp, Homo sapiens
gttttattttgattt

SEQ ID NO: 480638 - DNA, 15 bp, Homo sapiens
ttttattttgatttc

SEQ ID NO: 480639 - DNA, 15 bp, Homo sapiens
tttattttgatttct

SEQ ID NO: 480640 - DNA, 15 bp, Homo sapiens
ttattttgatttctg

SEQ ID NO: 480641 - DNA, 15 bp, Homo sapiens
tattttgatttctgg

SEQ ID NO: 480642 - DNA, 15 bp, Homo sapiens
attttgatttctggc

SEQ ID NO: 480643 - DNA, 15 bp, Homo sapiens
ttttgatttctggca

SEQ ID NO: 480644 - DNA, 15 bp, Homo sapiens
tttgatttctggcag

SEQ ID NO: 480645 - DNA, 15 bp, Homo sapiens
ttgatttctggcaga

SEQ ID NO: 480646 - DNA, 15 bp, Homo sapiens
tgatttctggcagat

SEQ ID NO: 480647 - DNA, 15 bp, Homo sapiens
gatttctggcagatt

SEQ ID NO: 480648 - DNA, 15 bp, Homo sapiens
atttctggcagattg

SEQ ID NO: 480649 - DNA, 15 bp, Homo sapiens
tttctggcagattgc

SEQ ID NO: 480650 - DNA, 15 bp, Homo sapiens
ttctggcagattgct

SEQ ID NO: 480651 - DNA, 15 bp, Homo sapiens
tctggcagattgctt

SEQ ID NO: 480652 - DNA, 15 bp, Homo sapiens
ctggcagattgcttg

SEQ ID NO: 480653 - DNA, 15 bp, Homo sapiens
tggcagattgcttgt

SEQ ID NO: 480654 - DNA, 15 bp, Homo sapiens
ggcagattgcttgtg

SEQ ID NO: 480655 - DNA, 15 bp, Homo sapiens
gcagattgcttgtga

SEQ ID NO: 480656 - DNA, 15 bp, Homo sapiens
cagattgcttgtgat

SEQ ID NO: 480657 - DNA, 15 bp, Homo sapiens
agattgcttgtgata

SEQ ID NO: 480658 - DNA, 15 bp, Homo sapiens
gattgcttgtgatac

SEQ ID NO: 480659 - DNA, 15 bp, Homo sapiens
attgcttgtgatact

SEQ ID NO: 480660 - DNA, 15 bp, Homo sapiens
ttgcttgtgatactt

SEQ ID NO: 480661 - DNA, 15 bp, Homo sapiens
tgcttgtgatacttt

SEQ ID NO: 480662 - DNA, 15 bp, Homo sapiens
gcttgtgatacttta

SEQ ID NO: 480663 - DNA, 15 bp, Homo sapiens
cttgtgatactttat

SEQ ID NO: 480664 - DNA, 15 bp, Homo sapiens
ttgtgatactttatc

SEQ ID NO: 480665 - DNA, 15 bp, Homo sapiens
tgtgatactttatct

SEQ ID NO: 480666 - DNA, 15 bp, Homo sapiens
gtgatactttatctt

SEQ ID NO: 480667 - DNA, 15 bp, Homo sapiens
tgatactttatcttt

SEQ ID NO: 480668 - DNA, 15 bp, Homo sapiens
gatactttatcttta

SEQ ID NO: 480669 - DNA, 15 bp, Homo sapiens
atactttatctttaa

SEQ ID NO: 480670 - DNA, 15 bp, Homo sapiens
tactttatctttaaa

SEQ ID NO: 480671 - DNA, 15 bp, Homo sapiens
actttatctttaaaa

SEQ ID NO: 480672 - DNA, 15 bp, Homo sapiens
ctttatctttaaaat

SEQ ID NO: 480673 - DNA, 15 bp, Homo sapiens
tttatctttaaaata

SEQ ID NO: 480674 - DNA, 15 bp, Homo sapiens
ttatctttaaaatac

SEQ ID NO: 480675 - DNA, 15 bp, Homo sapiens
tatctttaaaataca

SEQ ID NO: 480676 - DNA, 15 bp, Homo sapiens
atctttaaaatacag

SEQ ID NO: 480677 - DNA, 15 bp, Homo sapiens
tctttaaaatacaga

SEQ ID NO: 480678 - DNA, 15 bp, Homo sapiens
ctttaaaatacagac

SEQ ID NO: 480679 - DNA, 15 bp, Homo sapiens
tttaaaatacagaca

SEQ ID NO: 480680 - DNA, 15 bp, Homo sapiens
ttaaaatacagacat

SEQ ID NO: 480681 - DNA, 15 bp, Homo sapiens
taaaatacagacatt

SEQ ID NO: 480682 - DNA, 15 bp, Homo sapiens
aaaatacagacattt

SEQ ID NO: 480683 - DNA, 15 bp, Homo sapiens
aaatacagacatttt

SEQ ID NO: 480684 - DNA, 15 bp, Homo sapiens
aatacagacattttc

SEQ ID NO: 480685 - DNA, 15 bp, Homo sapiens
atacagacattttcc

SEQ ID NO: 480686 - DNA, 15 bp, Homo sapiens
tacagacattttcca

SEQ ID NO: 480687 - DNA, 15 bp, Homo sapiens
acagacattttccag

SEQ ID NO: 480688 - DNA, 15 bp, Homo sapiens
cagacattttccagg

SEQ ID NO: 480689 - DNA, 15 bp, Homo sapiens
agacattttccaggg

SEQ ID NO: 480690 - DNA, 15 bp, Homo sapiens
gacattttccaggga

SEQ ID NO: 480691 - DNA, 15 bp, Homo sapiens
acattttccagggat

SEQ ID NO: 480692 - DNA, 15 bp, Homo sapiens
cattttccagggata

SEQ ID NO: 480693 - DNA, 15 bp, Homo sapiens
attttccagggatac

SEQ ID NO: 480694 - DNA, 15 bp, Homo sapiens
ttttccagggataca

SEQ ID NO: 480695 - DNA, 15 bp, Homo sapiens
tttccagggatacat

SEQ ID NO: 480696 - DNA, 15 bp, Homo sapiens
ttccagggatacata

SEQ ID NO: 480697 - DNA, 15 bp, Homo sapiens
tccagggatacatat

SEQ ID NO: 480698 - DNA, 15 bp, Homo sapiens
ccagggatacatatg

SEQ ID NO: 480699 - DNA, 15 bp, Homo sapiens
cagggatacatatga

SEQ ID NO: 480700 - DNA, 15 bp, Homo sapiens
agggatacatatgaa

SEQ ID NO: 480701 - DNA, 15 bp, Homo sapiens
gggatacatatgaat

SEQ ID NO: 480702 - DNA, 15 bp, Homo sapiens
ggatacatatgaatg

SEQ ID NO: 480703 - DNA, 15 bp, Homo sapiens
gatacatatgaatgt

SEQ ID NO: 480704 - DNA, 15 bp, Homo sapiens
atacatatgaatgtg

SEQ ID NO: 480705 - DNA, 15 bp, Homo sapiens
tacatatgaatgtgc

SEQ ID NO: 480706 - DNA, 15 bp, Homo sapiens
acatatgaatgtgct

SEQ ID NO: 480707 - DNA, 15 bp, Homo sapiens
catatgaatgtgctt

SEQ ID NO: 480708 - DNA, 15 bp, Homo sapiens
atatgaatgtgcttc

SEQ ID NO: 480709 - DNA, 15 bp, Homo sapiens
tatgaatgtgcttct

SEQ ID NO: 480710 - DNA, 15 bp, Homo sapiens
atgaatgtgcttctt

SEQ ID NO: 480711 - DNA, 15 bp, Homo sapiens
tgaatgtgcttcttt

SEQ ID NO: 480712 - DNA, 15 bp, Homo sapiens
gaatgtgcttctttt

SEQ ID NO: 480713 - DNA, 15 bp, Homo sapiens
aatgtgcttcttttg

SEQ ID NO: 480714 - DNA, 15 bp, Homo sapiens
atgtgcttcttttgt

SEQ ID NO: 480715 - DNA, 15 bp, Homo sapiens
tgtgcttcttttgtt

SEQ ID NO: 480716 - DNA, 15 bp, Homo sapiens
gtgcttcttttgtta

SEQ ID NO: 480717 - DNA, 15 bp, Homo sapiens
tgcttcttttgttat

SEQ ID NO: 480718 - DNA, 15 bp, Homo sapiens
gcttcttttgttatt

SEQ ID NO: 480719 - DNA, 15 bp, Homo sapiens
cttcttttgttatta

SEQ ID NO: 480720 - DNA, 15 bp, Homo sapiens
ttcttttgttattat

SEQ ID NO: 480721 - DNA, 15 bp, Homo sapiens
tcttttgttattatt

SEQ ID NO: 480722 - DNA, 15 bp, Homo sapiens
ttgttattattattt

SEQ ID NO: 480723 - DNA, 15 bp, Homo sapiens
tgttattattatttt

SEQ ID NO: 480724 - DNA, 15 bp, Homo sapiens
gttattattattttt

SEQ ID NO: 480725 - DNA, 15 bp, Homo sapiens
ttattattatttttg

SEQ ID NO: 480726 - DNA, 15 bp, Homo sapiens
tattattatttttgg

SEQ ID NO: 480727 - DNA, 15 bp, Homo sapiens
attattatttttggg

SEQ ID NO: 480728 - DNA, 15 bp, Homo sapiens
ttattatttttgggt

SEQ ID NO: 480729 - DNA, 15 bp, Homo sapiens
tattatttttgggta

SEQ ID NO: 480730 - DNA, 15 bp, Homo sapiens
attatttttgggtac

SEQ ID NO: 480731 - DNA, 15 bp, Homo sapiens
ttatttttgggtact

SEQ ID NO: 480732 - DNA, 15 bp, Homo sapiens
tatttttgggtactc

SEQ ID NO: 480733 - DNA, 15 bp, Homo sapiens
atttttgggtactct

SEQ ID NO: 480734 - DNA, 15 bp, Homo sapiens
tttttgggtactctg

SEQ ID NO: 480735 - DNA, 15 bp, Homo sapiens
ttttgggtactctgt

SEQ ID NO: 480736 - DNA, 15 bp, Homo sapiens
tttgggtactctgtc

SEQ ID NO: 480737 - DNA, 15 bp, Homo sapiens
ttgggtactctgtct

SEQ ID NO: 480738 - DNA, 15 bp, Homo sapiens
tgggtactctgtctt

SEQ ID NO: 480739 - DNA, 15 bp, Homo sapiens
gggtactctgtcttt

SEQ ID NO: 480740 - DNA, 15 bp, Homo sapiens
ggtactctgtcttta

SEQ ID NO: 480741 - DNA, 15 bp, Homo sapiens
gtactctgtctttat

SEQ ID NO: 480742 - DNA, 15 bp, Homo sapiens
tactctgtctttata

SEQ ID NO: 480743 - DNA, 15 bp, Homo sapiens
actctgtctttatag

SEQ ID NO: 480744 - DNA, 15 bp, Homo sapiens
ctctgtctttatagt

SEQ ID NO: 480745 - DNA, 15 bp, Homo sapiens
tctgtctttatagtt

SEQ ID NO: 480746 - DNA, 15 bp, Homo sapiens
ctgtctttatagttt

SEQ ID NO: 480747 - DNA, 15 bp, Homo sapiens
tgtctttatagtttc

SEQ ID NO: 480748 - DNA, 15 bp, Homo sapiens
gtctttatagtttct

SEQ ID NO: 480749 - DNA, 15 bp, Homo sapiens
tctttatagtttcta

SEQ ID NO: 480750 - DNA, 15 bp, Homo sapiens
ctttatagtttctat

SEQ ID NO: 480751 - DNA, 15 bp, Homo sapiens
tttatagtttctata

SEQ ID NO: 480752 - DNA, 15 bp, Homo sapiens
ttatagtttctatac

SEQ ID NO: 480753 - DNA, 15 bp, Homo sapiens
tatagtttctatact

SEQ ID NO: 480754 - DNA, 15 bp, Homo sapiens
atagtttctatactc

SEQ ID NO: 480755 - DNA, 15 bp, Homo sapiens
tagtttctatactca

SEQ ID NO: 480756 - DNA, 15 bp, Homo sapiens
agtttctatactcag

SEQ ID NO: 480757 - DNA, 15 bp, Homo sapiens
gtttctatactcaga

SEQ ID NO: 480758 - DNA, 15 bp, Homo sapiens
tttctatactcagat

SEQ ID NO: 480759 - DNA, 15 bp, Homo sapiens
ttctatactcagatc

SEQ ID NO: 480760 - DNA, 15 bp, Homo sapiens
tctatactcagatct

SEQ ID NO: 480761 - DNA, 15 bp, Homo sapiens
ctatactcagatctt

SEQ ID NO: 480762 - DNA, 15 bp, Homo sapiens
tatactcagatcttt

SEQ ID NO: 480763 - DNA, 15 bp, Homo sapiens
atactcagatctttt

SEQ ID NO: 480764 - DNA, 15 bp, Homo sapiens
tactcagatcttttt

SEQ ID NO: 480765 - DNA, 15 bp, Homo sapiens
actcagatctttttc

SEQ ID NO: 480766 - DNA, 15 bp, Homo sapiens
ctcagatctttttca

SEQ ID NO: 480767 - DNA, 15 bp, Homo sapiens
tcagatctttttcat

SEQ ID NO: 480768 - DNA, 15 bp, Homo sapiens
cagatctttttcatc

SEQ ID NO: 480769 - DNA, 15 bp, Homo sapiens
agatctttttcatcc

SEQ ID NO: 480770 - DNA, 15 bp, Homo sapiens
gatctttttcatcct

SEQ ID NO: 480771 - DNA, 15 bp, Homo sapiens
atctttttcatcctg

SEQ ID NO: 480772 - DNA, 15 bp, Homo sapiens
tctttttcatcctga

SEQ ID NO: 480773 - DNA, 15 bp, Homo sapiens
ctttttcatcctgag

SEQ ID NO: 480774 - DNA, 15 bp, Homo sapiens
tttttcatcctgaga

SEQ ID NO: 480775 - DNA, 15 bp, Homo sapiens
ttttcatcctgagaa

SEQ ID NO: 480776 - DNA, 15 bp, Homo sapiens
tttcatcctgagaaa

SEQ ID NO: 480777 - DNA, 15 bp, Homo sapiens
ttcatcctgagaaat

SEQ ID NO: 480778 - DNA, 15 bp, Homo sapiens
tcatcctgagaaatg

SEQ ID NO: 480779 - DNA, 15 bp, Homo sapiens
catcctgagaaatga

SEQ ID NO: 480780 - DNA, 15 bp, Homo sapiens
atcctgagaaatgag

SEQ ID NO: 480781 - DNA, 15 bp, Homo sapiens
tcctgagaaatgaga

SEQ ID NO: 480782 - DNA, 15 bp, Homo sapiens
cctgagaaatgagaa

SEQ ID NO: 480783 - DNA, 15 bp, Homo sapiens
ctgagaaatgagaaa

SEQ ID NO: 480784 - DNA, 15 bp, Homo sapiens
tgagaaatgagaaat

SEQ ID NO: 480785 - DNA, 15 bp, Homo sapiens
gagaaatgagaaata

SEQ ID NO: 480786 - DNA, 15 bp, Homo sapiens
agaaatgagaaatat

SEQ ID NO: 480787 - DNA, 15 bp, Homo sapiens
gaaatgagaaatatt

SEQ ID NO: 480788 - DNA, 15 bp, Homo sapiens
aaatgagaaatattt

SEQ ID NO: 480789 - DNA, 15 bp, Homo sapiens
aatgagaaatattta

SEQ ID NO: 480790 - DNA, 15 bp, Homo sapiens
atgagaaatatttac

SEQ ID NO: 480791 - DNA, 15 bp, Homo sapiens
tgagaaatatttaca

SEQ ID NO: 480792 - DNA, 15 bp, Homo sapiens
gagaaatatttacag

SEQ ID NO: 480793 - DNA, 15 bp, Homo sapiens
agaaatatttacagg

SEQ ID NO: 480794 - DNA, 15 bp, Homo sapiens
gaaatatttacagga

SEQ ID NO: 480795 - DNA, 15 bp, Homo sapiens
aaatatttacaggat

SEQ ID NO: 480796 - DNA, 15 bp, Homo sapiens
aatatttacaggatg

SEQ ID NO: 480797 - DNA, 15 bp, Homo sapiens
atatttacaggatgt

SEQ ID NO: 480798 - DNA, 15 bp, Homo sapiens
tatttacaggatgtt

SEQ ID NO: 480799 - DNA, 15 bp, Homo sapiens
atttacaggatgttc

SEQ ID NO: 480800 - DNA, 15 bp, Homo sapiens
tttacaggatgttct

SEQ ID NO: 480801 - DNA, 15 bp, Homo sapiens
ttacaggatgttcta

SEQ ID NO: 480802 - DNA, 15 bp, Homo sapiens
tacaggatgttctac

SEQ ID NO: 480803 - DNA, 15 bp, Homo sapiens
acaggatgttctact

SEQ ID NO: 480804 - DNA, 15 bp, Homo sapiens
caggatgttctactg

SEQ ID NO: 480805 - DNA, 15 bp, Homo sapiens
aggatgttctactga

SEQ ID NO: 480806 - DNA, 15 bp, Homo sapiens
ggatgttctactgaa

SEQ ID NO: 480807 - DNA, 15 bp, Homo sapiens
gatgttctactgaac

SEQ ID NO: 480808 - DNA, 15 bp, Homo sapiens
atgttctactgaact

SEQ ID NO: 480809 - DNA, 15 bp, Homo sapiens
tgttctactgaactc

SEQ ID NO: 480810 - DNA, 15 bp, Homo sapiens
gttctactgaactct

SEQ ID NO: 480811 - DNA, 15 bp, Homo sapiens
ttctactgaactctt

SEQ ID NO: 480812 - DNA, 15 bp, Homo sapiens
tctactgaactctta

SEQ ID NO: 480813 - DNA, 15 bp, Homo sapiens
ctactgaactcttat

SEQ ID NO: 480814 - DNA, 15 bp, Homo sapiens
tactgaactcttatt

SEQ ID NO: 480815 - DNA, 15 bp, Homo sapiens
actgaactcttattt

SEQ ID NO: 480816 - DNA, 15 bp, Homo sapiens
ctgaactcttatttt

SEQ ID NO: 480817 - DNA, 15 bp, Homo sapiens
tgaactcttattttg

SEQ ID NO: 480818 - DNA, 15 bp, Homo sapiens
gaactcttattttgc

SEQ ID NO: 480819 - DNA, 15 bp, Homo sapiens
aactcttattttgct

SEQ ID NO: 480820 - DNA, 15 bp, Homo sapiens
actcttattttgctg

SEQ ID NO: 480821 - DNA, 15 bp, Homo sapiens
ctcttattttgctgt

SEQ ID NO: 480822 - DNA, 15 bp, Homo sapiens
tcttattttgctgtt

SEQ ID NO: 480823 - DNA, 15 bp, Homo sapiens
cttattttgctgttt

SEQ ID NO: 480824 - DNA, 15 bp, Homo sapiens
ttattttgctgtttt

SEQ ID NO: 480825 - DNA, 15 bp, Homo sapiens
tattttgctgtttta

SEQ ID NO: 480826 - DNA, 15 bp, Homo sapiens
attttgctgttttat

SEQ ID NO: 480827 - DNA, 15 bp, Homo sapiens
ttttgctgttttatt

SEQ ID NO: 480828 - DNA, 15 bp, Homo sapiens
tttgctgttttattt

SEQ ID NO: 480829 - DNA, 15 bp, Homo sapiens
ttgctgttttatttt

SEQ ID NO: 480830 - DNA, 15 bp, Homo sapiens
tgctgttttatttta

SEQ ID NO: 480831 - DNA, 15 bp, Homo sapiens
gctgttttattttat

SEQ ID NO: 480832 - DNA, 15 bp, Homo sapiens
ctgttttattttata

SEQ ID NO: 480833 - DNA, 15 bp, Homo sapiens
tgttttattttatat

SEQ ID NO: 480834 - DNA, 15 bp, Homo sapiens
gttttattttatatc

SEQ ID NO: 480835 - DNA, 15 bp, Homo sapiens
ttttattttatatct

SEQ ID NO: 480836 - DNA, 15 bp, Homo sapiens
tttattttatatcta

SEQ ID NO: 480837 - DNA, 15 bp, Homo sapiens
ttattttatatctat

SEQ ID NO: 480838 - DNA, 15 bp, Homo sapiens
tattttatatctatc

SEQ ID NO: 480839 - DNA, 15 bp, Homo sapiens
attttatatctatct

SEQ ID NO: 480840 - DNA, 15 bp, Homo sapiens
ttttatatctatcta

SEQ ID NO: 480841 - DNA, 15 bp, Homo sapiens
tttatatctatctac

SEQ ID NO: 480842 - DNA, 15 bp, Homo sapiens
ttatatctatctact

SEQ ID NO: 480843 - DNA, 15 bp, Homo sapiens
tatatctatctacta

SEQ ID NO: 480844 - DNA, 15 bp, Homo sapiens
atatctatctactat

SEQ ID NO: 480845 - DNA, 15 bp, Homo sapiens
tatctatctactata

SEQ ID NO: 480846 - DNA, 15 bp, Homo sapiens
atctatctactatat

SEQ ID NO: 480847 - DNA, 15 bp, Homo sapiens
tctatctactatatc

SEQ ID NO: 480848 - DNA, 15 bp, Homo sapiens
ctatctactatatct

SEQ ID NO: 480849 - DNA, 15 bp, Homo sapiens
tatctactatatctt

SEQ ID NO: 480850 - DNA, 15 bp, Homo sapiens
atctactatatcttt

SEQ ID NO: 480851 - DNA, 15 bp, Homo sapiens
tctactatatcttta

SEQ ID NO: 480852 - DNA, 15 bp, Homo sapiens
ctactatatctttac

SEQ ID NO: 480853 - DNA, 15 bp, Homo sapiens
tactatatctttacg

SEQ ID NO: 480854 - DNA, 15 bp, Homo sapiens
actatatctttacgc

SEQ ID NO: 480855 - DNA, 15 bp, Homo sapiens
ctatatctttacgct

SEQ ID NO: 480856 - DNA, 15 bp, Homo sapiens
tatatctttacgctt

SEQ ID NO: 480857 - DNA, 15 bp, Homo sapiens
atatctttacgcttt

SEQ ID NO: 480858 - DNA, 15 bp, Homo sapiens
tatctttacgctttg

SEQ ID NO: 480859 - DNA, 15 bp, Homo sapiens
atctttacgctttgt

SEQ ID NO: 480860 - DNA, 15 bp, Homo sapiens
tctttacgctttgtc

SEQ ID NO: 480861 - DNA, 15 bp, Homo sapiens
ctttacgctttgtcc

SEQ ID NO: 480862 - DNA, 15 bp, Homo sapiens
tttacgctttgtcca

SEQ ID NO: 480863 - DNA, 15 bp, Homo sapiens
ttacgctttgtccat

SEQ ID NO: 480864 - DNA, 15 bp, Homo sapiens
tacgctttgtccatt

SEQ ID NO: 480865 - DNA, 15 bp, Homo sapiens
acgctttgtccattt

SEQ ID NO: 480866 - DNA, 15 bp, Homo sapiens
cgctttgtccatttg

SEQ ID NO: 480867 - DNA, 15 bp, Homo sapiens
gctttgtccatttgt

SEQ ID NO: 480868 - DNA, 15 bp, Homo sapiens
ctttgtccatttgtc

SEQ ID NO: 480869 - DNA, 15 bp, Homo sapiens
tttgtccatttgtcc

SEQ ID NO: 480870 - DNA, 15 bp, Homo sapiens
ttgtccatttgtcct

SEQ ID NO: 480871 - DNA, 15 bp, Homo sapiens
tgtccatttgtccta

SEQ ID NO: 480872 - DNA, 15 bp, Homo sapiens
gtccatttgtcctat

SEQ ID NO: 480873 - DNA, 15 bp, Homo sapiens
tccatttgtcctatc

SEQ ID NO: 480874 - DNA, 15 bp, Homo sapiens
ccatttgtcctatcc

SEQ ID NO: 480875 - DNA, 15 bp, Homo sapiens
catttgtcctatcca

SEQ ID NO: 480876 - DNA, 15 bp, Homo sapiens
atttgtcctatccat

SEQ ID NO: 480877 - DNA, 15 bp, Homo sapiens
tttgtcctatccata

SEQ ID NO: 480878 - DNA, 15 bp, Homo sapiens
ttgtcctatccatat

SEQ ID NO: 480879 - DNA, 15 bp, Homo sapiens
tgtcctatccatatg

SEQ ID NO: 480880 - DNA, 15 bp, Homo sapiens
gtcctatccatatgt

SEQ ID NO: 480881 - DNA, 15 bp, Homo sapiens
tcctatccatatgtt

SEQ ID NO: 480882 - DNA, 15 bp, Homo sapiens
cctatccatatgtta

SEQ ID NO: 480883 - DNA, 15 bp, Homo sapiens
ctatccatatgttag

SEQ ID NO: 480884 - DNA, 15 bp, Homo sapiens
tatccatatgttaga

SEQ ID NO: 480885 - DNA, 15 bp, Homo sapiens
atccatatgttagag

SEQ ID NO: 480886 - DNA, 15 bp, Homo sapiens
tccatatgttagagc

SEQ ID NO: 480887 - DNA, 15 bp, Homo sapiens
ccatatgttagagct

SEQ ID NO: 480888 - DNA, 15 bp, Homo sapiens
catatgttagagctg

SEQ ID NO: 480889 - DNA, 15 bp, Homo sapiens
atatgttagagctgc

SEQ ID NO: 480890 - DNA, 15 bp, Homo sapiens
tatgttagagctgct

SEQ ID NO: 480891 - DNA, 15 bp, Homo sapiens
atgttagagctgctc

SEQ ID NO: 480892 - DNA, 15 bp, Homo sapiens
tgttagagctgctct

SEQ ID NO: 480893 - DNA, 15 bp, Homo sapiens
gttagagctgctctt

SEQ ID NO: 480894 - DNA, 15 bp, Homo sapiens
ttagagctgctcttt

SEQ ID NO: 480895 - DNA, 15 bp, Homo sapiens
tagagctgctctttt

SEQ ID NO: 480896 - DNA, 15 bp, Homo sapiens
agagctgctcttttg

SEQ ID NO: 480897 - DNA, 15 bp, Homo sapiens
gagctgctcttttgt

SEQ ID NO: 480898 - DNA, 15 bp, Homo sapiens
agctgctcttttgtc

SEQ ID NO: 480899 - DNA, 15 bp, Homo sapiens
gctgctcttttgtca

SEQ ID NO: 480900 - DNA, 15 bp, Homo sapiens
ctgctcttttgtcat

SEQ ID NO: 480901 - DNA, 15 bp, Homo sapiens
tgctcttttgtcatg

SEQ ID NO: 480902 - DNA, 15 bp, Homo sapiens
gctcttttgtcatgt

SEQ ID NO: 480903 - DNA, 15 bp, Homo sapiens
ctcttttgtcatgtt

SEQ ID NO: 480904 - DNA, 15 bp, Homo sapiens
tcttttgtcatgttt

SEQ ID NO: 480905 - DNA, 15 bp, Homo sapiens
cttttgtcatgtttt

SEQ ID NO: 480906 - DNA, 15 bp, Homo sapiens
ttttgtcatgtttta

SEQ ID NO: 480907 - DNA, 15 bp, Homo sapiens
tttgtcatgttttat

SEQ ID NO: 480908 - DNA, 15 bp, Homo sapiens
ttgtcatgttttatc

SEQ ID NO: 480909 - DNA, 15 bp, Homo sapiens
tgtcatgttttatca

SEQ ID NO: 480910 - DNA, 15 bp, Homo sapiens
gtcatgttttatcac

SEQ ID NO: 480911 - DNA, 15 bp, Homo sapiens
tcatgttttatcacc

SEQ ID NO: 480912 - DNA, 15 bp, Homo sapiens
catgttttatcacct

SEQ ID NO: 480913 - DNA, 15 bp, Homo sapiens
atgttttatcacctc

SEQ ID NO: 480914 - DNA, 15 bp, Homo sapiens
tgttttatcacctct

SEQ ID NO: 480915 - DNA, 15 bp, Homo sapiens
gttttatcacctctc

SEQ ID NO: 480916 - DNA, 15 bp, Homo sapiens
ttttatcacctctct

SEQ ID NO: 480917 - DNA, 15 bp, Homo sapiens
tttatcacctctctc

SEQ ID NO: 480918 - DNA, 15 bp, Homo sapiens
ttatcacctctctct

SEQ ID NO: 480919 - DNA, 15 bp, Homo sapiens
tatcacctctctctt

SEQ ID NO: 480920 - DNA, 15 bp, Homo sapiens
atcacctctctcttc

SEQ ID NO: 480921 - DNA, 15 bp, Homo sapiens
tcacctctctcttca

SEQ ID NO: 480922 - DNA, 15 bp, Homo sapiens
cacctctctcttcac

SEQ ID NO: 480923 - DNA, 15 bp, Homo sapiens
acctctctcttcaca

SEQ ID NO: 480924 - DNA, 15 bp, Homo sapiens
cctctctcttcacat

SEQ ID NO: 480925 - DNA, 15 bp, Homo sapiens
ctctctcttcacatg

SEQ ID NO: 480926 - DNA, 15 bp, Homo sapiens
tctctcttcacatga

SEQ ID NO: 480927 - DNA, 15 bp, Homo sapiens
ctctcttcacatgaa

SEQ ID NO: 480928 - DNA, 15 bp, Homo sapiens
tctcttcacatgaac

SEQ ID NO: 480929 - DNA, 15 bp, Homo sapiens
ctcttcacatgaact

SEQ ID NO: 480930 - DNA, 15 bp, Homo sapiens
tcttcacatgaactt

SEQ ID NO: 480931 - DNA, 15 bp, Homo sapiens
cttcacatgaacttg

SEQ ID NO: 480932 - DNA, 15 bp, Homo sapiens
ttcacatgaacttgg

SEQ ID NO: 480933 - DNA, 15 bp, Homo sapiens
tcacatgaacttggt

SEQ ID NO: 480934 - DNA, 15 bp, Homo sapiens
cacatgaacttggtg

SEQ ID NO: 480935 - DNA, 15 bp, Homo sapiens
acatgaacttggtga

SEQ ID NO: 480936 - DNA, 15 bp, Homo sapiens
catgaacttggtgag

SEQ ID NO: 480937 - DNA, 15 bp, Homo sapiens
atgaacttggtgagg

SEQ ID NO: 480938 - DNA, 15 bp, Homo sapiens
tgaacttggtgaggt

SEQ ID NO: 480939 - DNA, 15 bp, Homo sapiens
gaacttggtgaggtg

SEQ ID NO: 480940 - DNA, 15 bp, Homo sapiens
aacttggtgaggtgc

SEQ ID NO: 480941 - DNA, 15 bp, Homo sapiens
acttggtgaggtgcc

SEQ ID NO: 480942 - DNA, 15 bp, Homo sapiens
cttggtgaggtgcct

SEQ ID NO: 480943 - DNA, 15 bp, Homo sapiens
ttggtgaggtgcctc

SEQ ID NO: 480944 - DNA, 15 bp, Homo sapiens
tggtgaggtgcctcc

SEQ ID NO: 480945 - DNA, 15 bp, Homo sapiens
ggtgaggtgcctcca

SEQ ID NO: 480946 - DNA, 15 bp, Homo sapiens
gtgaggtgcctccag

SEQ ID NO: 480947 - DNA, 15 bp, Homo sapiens
tgaggtgcctccagg

SEQ ID NO: 480948 - DNA, 15 bp, Homo sapiens
gaggtgcctccaggc

SEQ ID NO: 480949 - DNA, 15 bp, Homo sapiens
aggtgcctccaggca

SEQ ID NO: 480950 - DNA, 15 bp, Homo sapiens
ggtgcctccaggcat

SEQ ID NO: 480951 - DNA, 15 bp, Homo sapiens
gtgcctccaggcatc

SEQ ID NO: 480952 - DNA, 15 bp, Homo sapiens
tgcctccaggcatcg

SEQ ID NO: 480953 - DNA, 15 bp, Homo sapiens
gcctccaggcatcgc

SEQ ID NO: 480954 - DNA, 15 bp, Homo sapiens
cctccaggcatcgct

SEQ ID NO: 480955 - DNA, 15 bp, Homo sapiens
ctccaggcatcgctg

SEQ ID NO: 480956 - DNA, 15 bp, Homo sapiens
tccaggcatcgctga

SEQ ID NO: 480957 - DNA, 15 bp, Homo sapiens
ccaggcatcgctgac

SEQ ID NO: 480958 - DNA, 15 bp, Homo sapiens
caggcatcgctgact

SEQ ID NO: 480959 - DNA, 15 bp, Homo sapiens
aggcatcgctgactt

SEQ ID NO: 480960 - DNA, 15 bp, Homo sapiens
ggcatcgctgacttt

SEQ ID NO: 480961 - DNA, 15 bp, Homo sapiens
gcatcgctgactttg

SEQ ID NO: 480962 - DNA, 15 bp, Homo sapiens
catcgctgactttgc

SEQ ID NO: 480963 - DNA, 15 bp, Homo sapiens
atcgctgactttgca

SEQ ID NO: 480964 - DNA, 15 bp, Homo sapiens
tcgctgactttgcat

SEQ ID NO: 480965 - DNA, 15 bp, Homo sapiens
cgctgactttgcatt

SEQ ID NO: 480966 - DNA, 15 bp, Homo sapiens
gctgactttgcattg

SEQ ID NO: 480967 - DNA, 15 bp, Homo sapiens
ctgactttgcattgt

SEQ ID NO: 480968 - DNA, 15 bp, Homo sapiens
tgactttgcattgtg

SEQ ID NO: 480969 - DNA, 15 bp, Homo sapiens
gactttgcattgtgt

SEQ ID NO: 480970 - DNA, 15 bp, Homo sapiens
actttgcattgtgta

SEQ ID NO: 480971 - DNA, 15 bp, Homo sapiens
ctttgcattgtgtaa

SEQ ID NO: 480972 - DNA, 15 bp, Homo sapiens
tttgcattgtgtaat

SEQ ID NO: 480973 - DNA, 15 bp, Homo sapiens
ttgcattgtgtaatt

SEQ ID NO: 480974 - DNA, 15 bp, Homo sapiens
tgcattgtgtaattc

SEQ ID NO: 480975 - DNA, 15 bp, Homo sapiens
gcattgtgtaattca

SEQ ID NO: 480976 - DNA, 15 bp, Homo sapiens
cattgtgtaattcac

SEQ ID NO: 480977 - DNA, 15 bp, Homo sapiens
attgtgtaattcact

SEQ ID NO: 480978 - DNA, 15 bp, Homo sapiens
ttgtgtaattcactg

SEQ ID NO: 480979 - DNA, 15 bp, Homo sapiens
tgtgtaattcactgc

SEQ ID NO: 480980 - DNA, 15 bp, Homo sapiens
gtgtaattcactgca

SEQ ID NO: 480981 - DNA, 15 bp, Homo sapiens
tgtaattcactgcag

SEQ ID NO: 480982 - DNA, 15 bp, Homo sapiens
gtaattcactgcagc

SEQ ID NO: 480983 - DNA, 15 bp, Homo sapiens
taattcactgcagct

SEQ ID NO: 480984 - DNA, 15 bp, Homo sapiens
aattcactgcagctc

SEQ ID NO: 480985 - DNA, 15 bp, Homo sapiens
attcactgcagctca

SEQ ID NO: 480986 - DNA, 15 bp, Homo sapiens
ttcactgcagctcat

SEQ ID NO: 480987 - DNA, 15 bp, Homo sapiens
tcactgcagctcatt

SEQ ID NO: 480988 - DNA, 15 bp, Homo sapiens
cactgcagctcattg

SEQ ID NO: 480989 - DNA, 15 bp, Homo sapiens
actgcagctcattgg

SEQ ID NO: 480990 - DNA, 15 bp, Homo sapiens
ctgcagctcattggt

SEQ ID NO: 480991 - DNA, 15 bp, Homo sapiens
tgcagctcattggtg

SEQ ID NO: 480992 - DNA, 15 bp, Homo sapiens
gcagctcattggtgt

SEQ ID NO: 480993 - DNA, 15 bp, Homo sapiens
cagctcattggtgtc

SEQ ID NO: 480994 - DNA, 15 bp, Homo sapiens
agctcattggtgtcc

SEQ ID NO: 480995 - DNA, 15 bp, Homo sapiens
gctcattggtgtcct

SEQ ID NO: 480996 - DNA, 15 bp, Homo sapiens
ctcattggtgtcctg

SEQ ID NO: 480997 - DNA, 15 bp, Homo sapiens
tcattggtgtcctgg

SEQ ID NO: 480998 - DNA, 15 bp, Homo sapiens
cattggtgtcctggt

SEQ ID NO: 480999 - DNA, 15 bp, Homo sapiens
attggtgtcctggtg

SEQ ID NO: 481000 - DNA, 15 bp, Homo sapiens
ttggtgtcctggtgg

SEQ ID NO: 481001 - DNA, 15 bp, Homo sapiens
tggtgtcctggtggt

SEQ ID NO: 481002 - DNA, 15 bp, Homo sapiens
ggtgtcctggtggtg

SEQ ID NO: 481003 - DNA, 15 bp, Homo sapiens
gtgtcctggtggtgt

SEQ ID NO: 481004 - DNA, 15 bp, Homo sapiens
tgtcctggtggtgtt

SEQ ID NO: 481005 - DNA, 15 bp, Homo sapiens
gtcctggtggtgttg

SEQ ID NO: 481006 - DNA, 15 bp, Homo sapiens
tcctggtggtgttga

SEQ ID NO: 481007 - DNA, 15 bp, Homo sapiens
cctggtggtgttgag

SEQ ID NO: 481008 - DNA, 15 bp, Homo sapiens
ctggtggtgttgaga

SEQ ID NO: 481009 - DNA, 15 bp, Homo sapiens
tggtggtgttgagac

SEQ ID NO: 481010 - DNA, 15 bp, Homo sapiens
ggtggtgttgagaca

SEQ ID NO: 481011 - DNA, 15 bp, Homo sapiens
gtggtgttgagacat

SEQ ID NO: 481012 - DNA, 15 bp, Homo sapiens
tggtgttgagacatt

SEQ ID NO: 481013 - DNA, 15 bp, Homo sapiens
ggtgttgagacatta

SEQ ID NO: 481014 - DNA, 15 bp, Homo sapiens
gtgttgagacattag

SEQ ID NO: 481015 - DNA, 15 bp, Homo sapiens
tgttgagacattagt

SEQ ID NO: 481016 - DNA, 15 bp, Homo sapiens
gttgagacattagtc

SEQ ID NO: 481017 - DNA, 15 bp, Homo sapiens
ttgagacattagtct

SEQ ID NO: 481018 - DNA, 15 bp, Homo sapiens
tgagacattagtctt

SEQ ID NO: 481019 - DNA, 15 bp, Homo sapiens
gagacattagtctta

SEQ ID NO: 481020 - DNA, 15 bp, Homo sapiens
agacattagtcttac

SEQ ID NO: 481021 - DNA, 15 bp, Homo sapiens
gacattagtcttaca

SEQ ID NO: 481022 - DNA, 15 bp, Homo sapiens
acattagtcttacag

SEQ ID NO: 481023 - DNA, 15 bp, Homo sapiens
cattagtcttacagc

SEQ ID NO: 481024 - DNA, 15 bp, Homo sapiens
attagtcttacagct

SEQ ID NO: 481025 - DNA, 15 bp, Homo sapiens
ttagtcttacagctt

SEQ ID NO: 481026 - DNA, 15 bp, Homo sapiens
tagtcttacagcttg

SEQ ID NO: 481027 - DNA, 15 bp, Homo sapiens
agtcttacagcttgc

SEQ ID NO: 481028 - DNA, 15 bp, Homo sapiens
gtcttacagcttgct

SEQ ID NO: 481029 - DNA, 15 bp, Homo sapiens
tcttacagcttgctt

SEQ ID NO: 481030 - DNA, 15 bp, Homo sapiens
cttacagcttgcttc

SEQ ID NO: 481031 - DNA, 15 bp, Homo sapiens
ttacagcttgcttct

SEQ ID NO: 481032 - DNA, 15 bp, Homo sapiens
tacagcttgcttctg

SEQ ID NO: 481033 - DNA, 15 bp, Homo sapiens
acagcttgcttctgc

SEQ ID NO: 481034 - DNA, 15 bp, Homo sapiens
cagcttgcttctgcc

SEQ ID NO: 481035 - DNA, 15 bp, Homo sapiens
agcttgcttctgccc

SEQ ID NO: 481036 - DNA, 15 bp, Homo sapiens
gcttgcttctgcccc

SEQ ID NO: 481037 - DNA, 15 bp, Homo sapiens
cttgcttctgccccg

SEQ ID NO: 481038 - DNA, 15 bp, Homo sapiens
ttgcttctgccccgg

SEQ ID NO: 481039 - DNA, 15 bp, Homo sapiens
tgcttctgccccgga

SEQ ID NO: 481040 - DNA, 15 bp, Homo sapiens
gcttctgccccggat

SEQ ID NO: 481041 - DNA, 15 bp, Homo sapiens
cttctgccccggata

SEQ ID NO: 481042 - DNA, 15 bp, Homo sapiens
ttctgccccggataa

SEQ ID NO: 481043 - DNA, 15 bp, Homo sapiens
tctgccccggataac

SEQ ID NO: 481044 - DNA, 15 bp, Homo sapiens
ctgccccggataaca

SEQ ID NO: 481045 - DNA, 15 bp, Homo sapiens
tgccccggataacac

SEQ ID NO: 481046 - DNA, 15 bp, Homo sapiens
gccccggataacaca

SEQ ID NO: 481047 - DNA, 15 bp, Homo sapiens
ccccggataacacag

SEQ ID NO: 481048 - DNA, 15 bp, Homo sapiens
cccggataacacagc

SEQ ID NO: 481049 - DNA, 15 bp, Homo sapiens
ccggataacacagct

SEQ ID NO: 481050 - DNA, 15 bp, Homo sapiens
cggataacacagcta

SEQ ID NO: 481051 - DNA, 15 bp, Homo sapiens
ggataacacagctag

SEQ ID NO: 481052 - DNA, 15 bp, Homo sapiens
gataacacagctagg

SEQ ID NO: 481053 - DNA, 15 bp, Homo sapiens
ataacacagctaggt

SEQ ID NO: 481054 - DNA, 15 bp, Homo sapiens
taacacagctaggtt

SEQ ID NO: 481055 - DNA, 15 bp, Homo sapiens
aacacagctaggttt

SEQ ID NO: 481056 - DNA, 15 bp, Homo sapiens
acacagctaggttta

SEQ ID NO: 481057 - DNA, 15 bp, Homo sapiens
cacagctaggtttag

SEQ ID NO: 481058 - DNA, 15 bp, Homo sapiens
acagctaggtttagg

SEQ ID NO: 481059 - DNA, 15 bp, Homo sapiens
cagctaggtttaggg

SEQ ID NO: 481060 - DNA, 15 bp, Homo sapiens
agctaggtttagggt

SEQ ID NO: 481061 - DNA, 15 bp, Homo sapiens
gctaggtttagggtg

SEQ ID NO: 481062 - DNA, 15 bp, Homo sapiens
ctaggtttagggtgt

SEQ ID NO: 481063 - DNA, 15 bp, Homo sapiens
taggtttagggtgtt

SEQ ID NO: 481064 - DNA, 15 bp, Homo sapiens
aggtttagggtgttg

SEQ ID NO: 481065 - DNA, 15 bp, Homo sapiens
ggtttagggtgttgg

SEQ ID NO: 481066 - DNA, 15 bp, Homo sapiens
gtttagggtgttggc

SEQ ID NO: 481067 - DNA, 15 bp, Homo sapiens
tttagggtgttggcc

SEQ ID NO: 481068 - DNA, 15 bp, Homo sapiens
ttagggtgttggcca

SEQ ID NO: 481069 - DNA, 15 bp, Homo sapiens
tagggtgttggccat

SEQ ID NO: 481070 - DNA, 15 bp, Homo sapiens
agggtgttggccatt

SEQ ID NO: 481071 - DNA, 15 bp, Homo sapiens
gggtgttggccattt

SEQ ID NO: 481072 - DNA, 15 bp, Homo sapiens
ggtgttggccattta

SEQ ID NO: 481073 - DNA, 15 bp, Homo sapiens
gtgttggccatttac

SEQ ID NO: 481074 - DNA, 15 bp, Homo sapiens
tgttggccatttact

SEQ ID NO: 481075 - DNA, 15 bp, Homo sapiens
gttggccatttactt

SEQ ID NO: 481076 - DNA, 15 bp, Homo sapiens
ttggccatttacttc

SEQ ID NO: 481077 - DNA, 15 bp, Homo sapiens
tggccatttacttcc

SEQ ID NO: 481078 - DNA, 15 bp, Homo sapiens
ggccatttacttcct

SEQ ID NO: 481079 - DNA, 15 bp, Homo sapiens
gccatttacttccta

SEQ ID NO: 481080 - DNA, 15 bp, Homo sapiens
ccatttacttcctat

SEQ ID NO: 481081 - DNA, 15 bp, Homo sapiens
catttacttcctatg

SEQ ID NO: 481082 - DNA, 15 bp, Homo sapiens
atttacttcctatga

SEQ ID NO: 481083 - DNA, 15 bp, Homo sapiens
tttacttcctatgag

SEQ ID NO: 481084 - DNA, 15 bp, Homo sapiens
ttacttcctatgagg

SEQ ID NO: 481085 - DNA, 15 bp, Homo sapiens
tacttcctatgagga

SEQ ID NO: 481086 - DNA, 15 bp, Homo sapiens
acttcctatgaggaa

SEQ ID NO: 481087 - DNA, 15 bp, Homo sapiens
cttcctatgaggaaa

SEQ ID NO: 481088 - DNA, 15 bp, Homo sapiens
ttcctatgaggaaaa

SEQ ID NO: 481089 - DNA, 15 bp, Homo sapiens
tcctatgaggaaaat

SEQ ID NO: 481090 - DNA, 15 bp, Homo sapiens
cctatgaggaaaata

SEQ ID NO: 481091 - DNA, 15 bp, Homo sapiens
ctatgaggaaaatat

SEQ ID NO: 481092 - DNA, 15 bp, Homo sapiens
tatgaggaaaatata

SEQ ID NO: 481093 - DNA, 15 bp, Homo sapiens
atgaggaaaatatac

SEQ ID NO: 481094 - DNA, 15 bp, Homo sapiens
tgaggaaaatataca

SEQ ID NO: 481095 - DNA, 15 bp, Homo sapiens
gaggaaaatatacac

SEQ ID NO: 481096 - DNA, 15 bp, Homo sapiens
aggaaaatatacaca

SEQ ID NO: 481097 - DNA, 15 bp, Homo sapiens
ggaaaatatacacat

SEQ ID NO: 481098 - DNA, 15 bp, Homo sapiens
gaaaatatacacata

SEQ ID NO: 481099 - DNA, 15 bp, Homo sapiens
aaaatatacacatac

SEQ ID NO: 481100 - DNA, 15 bp, Homo sapiens
aaatatacacataca

SEQ ID NO: 481101 - DNA, 15 bp, Homo sapiens
aatatacacatacac

SEQ ID NO: 481102 - DNA, 15 bp, Homo sapiens
tatacacatacacag

SEQ ID NO: 481103 - DNA, 15 bp, Homo sapiens
atacacatacacaga

SEQ ID NO: 481104 - DNA, 15 bp, Homo sapiens
tacacatacacagac

SEQ ID NO: 481105 - DNA, 15 bp, Homo sapiens
acacatacacagacc

SEQ ID NO: 481106 - DNA, 15 bp, Homo sapiens
cacatacacagaccc

SEQ ID NO: 481107 - DNA, 15 bp, Homo sapiens
acatacacagaccca

SEQ ID NO: 481108 - DNA, 15 bp, Homo sapiens
catacacagacccat

SEQ ID NO: 481109 - DNA, 15 bp, Homo sapiens
atacacagacccata

SEQ ID NO: 481110 - DNA, 15 bp, Homo sapiens
tacacagacccatat

SEQ ID NO: 481111 - DNA, 15 bp, Homo sapiens
acacagacccatatc

SEQ ID NO: 481112 - DNA, 15 bp, Homo sapiens
cacagacccatatct

SEQ ID NO: 481113 - DNA, 15 bp, Homo sapiens
acagacccatatctc

SEQ ID NO: 481114 - DNA, 15 bp, Homo sapiens
cagacccatatctcc

SEQ ID NO: 481115 - DNA, 15 bp, Homo sapiens
agacccatatctccc

SEQ ID NO: 481116 - DNA, 15 bp, Homo sapiens
gacccatatctccct

SEQ ID NO: 481117 - DNA, 15 bp, Homo sapiens
acccatatctccctg

SEQ ID NO: 481118 - DNA, 15 bp, Homo sapiens
cccatatctccctgc

SEQ ID NO: 481119 - DNA, 15 bp, Homo sapiens
ccatatctccctgcc

SEQ ID NO: 481120 - DNA, 15 bp, Homo sapiens
catatctccctgcca

SEQ ID NO: 481121 - DNA, 15 bp, Homo sapiens
atatctccctgccag

SEQ ID NO: 481122 - DNA, 15 bp, Homo sapiens
tatctccctgccagt

SEQ ID NO: 481123 - DNA, 15 bp, Homo sapiens
atctccctgccagtc

SEQ ID NO: 481124 - DNA, 15 bp, Homo sapiens
tctccctgccagtct

SEQ ID NO: 481125 - DNA, 15 bp, Homo sapiens
ctccctgccagtctg

SEQ ID NO: 481126 - DNA, 15 bp, Homo sapiens
tccctgccagtctgt

SEQ ID NO: 481127 - DNA, 15 bp, Homo sapiens
ccctgccagtctgtt

SEQ ID NO: 481128 - DNA, 15 bp, Homo sapiens
cctgccagtctgttt

SEQ ID NO: 481129 - DNA, 15 bp, Homo sapiens
ctgccagtctgtttg

SEQ ID NO: 481130 - DNA, 15 bp, Homo sapiens
tgccagtctgtttga

SEQ ID NO: 481131 - DNA, 15 bp, Homo sapiens
gccagtctgtttgat

SEQ ID NO: 481132 - DNA, 15 bp, Homo sapiens
ccagtctgtttgatt

SEQ ID NO: 481133 - DNA, 15 bp, Homo sapiens
cagtctgtttgattt

SEQ ID NO: 481134 - DNA, 15 bp, Homo sapiens
agtctgtttgattta

SEQ ID NO: 481135 - DNA, 15 bp, Homo sapiens
gtctgtttgatttag

SEQ ID NO: 481136 - DNA, 15 bp, Homo sapiens
tctgtttgatttagc

SEQ ID NO: 481137 - DNA, 15 bp, Homo sapiens
ctgtttgatttagct

SEQ ID NO: 481138 - DNA, 15 bp, Homo sapiens
tgtttgatttagcta

SEQ ID NO: 481139 - DNA, 15 bp, Homo sapiens
gtttgatttagctac

SEQ ID NO: 481140 - DNA, 15 bp, Homo sapiens
tttgatttagctaca

SEQ ID NO: 481141 - DNA, 15 bp, Homo sapiens
ttgatttagctacat

SEQ ID NO: 481142 - DNA, 15 bp, Homo sapiens
tgatttagctacatg

SEQ ID NO: 481143 - DNA, 15 bp, Homo sapiens
gatttagctacatgg

SEQ ID NO: 481144 - DNA, 15 bp, Homo sapiens
atttagctacatggg

SEQ ID NO: 481145 - DNA, 15 bp, Homo sapiens
tttagctacatggga

SEQ ID NO: 481146 - DNA, 15 bp, Homo sapiens
ttagctacatgggaa

SEQ ID NO: 481147 - DNA, 15 bp, Homo sapiens
tagctacatgggaaa

SEQ ID NO: 481148 - DNA, 15 bp, Homo sapiens
agctacatgggaaac

SEQ ID NO: 481149 - DNA, 15 bp, Homo sapiens
gctacatgggaaact

SEQ ID NO: 481150 - DNA, 15 bp, Homo sapiens
ctacatgggaaactg

SEQ ID NO: 481151 - DNA, 15 bp, Homo sapiens
tacatgggaaactga

SEQ ID NO: 481152 - DNA, 15 bp, Homo sapiens
acatgggaaactgag

SEQ ID NO: 481153 - DNA, 15 bp, Homo sapiens
catgggaaactgagg

SEQ ID NO: 481154 - DNA, 15 bp, Homo sapiens
atgggaaactgagga

SEQ ID NO: 481155 - DNA, 15 bp, Homo sapiens
tgggaaactgaggag

SEQ ID NO: 481156 - DNA, 15 bp, Homo sapiens
gggaaactgaggagc

SEQ ID NO: 481157 - DNA, 15 bp, Homo sapiens
ggaaactgaggagct

SEQ ID NO: 481158 - DNA, 15 bp, Homo sapiens
gaaactgaggagctt

SEQ ID NO: 481159 - DNA, 15 bp, Homo sapiens
aaactgaggagcttt

SEQ ID NO: 481160 - DNA, 15 bp, Homo sapiens
aactgaggagctttt

SEQ ID NO: 481161 - DNA, 15 bp, Homo sapiens
actgaggagcttttg

SEQ ID NO: 481162 - DNA, 15 bp, Homo sapiens
ctgaggagcttttgg

SEQ ID NO: 481163 - DNA, 15 bp, Homo sapiens
tgaggagcttttgga

SEQ ID NO: 481164 - DNA, 15 bp, Homo sapiens
gaggagcttttggat

SEQ ID NO: 481165 - DNA, 15 bp, Homo sapiens
aggagcttttggatt

SEQ ID NO: 481166 - DNA, 15 bp, Homo sapiens
ggagcttttggattg

SEQ ID NO: 481167 - DNA, 15 bp, Homo sapiens
gagcttttggattgc

SEQ ID NO: 481168 - DNA, 15 bp, Homo sapiens
agcttttggattgct

SEQ ID NO: 481169 - DNA, 15 bp, Homo sapiens
gcttttggattgctt

SEQ ID NO: 481170 - DNA, 15 bp, Homo sapiens
cttttggattgcttt

SEQ ID NO: 481171 - DNA, 15 bp, Homo sapiens
ttttggattgctttc

SEQ ID NO: 481172 - DNA, 15 bp, Homo sapiens
tttggattgctttca

SEQ ID NO: 481173 - DNA, 15 bp, Homo sapiens
ttggattgctttcaa

SEQ ID NO: 481174 - DNA, 15 bp, Homo sapiens
tggattgctttcaaa

SEQ ID NO: 481175 - DNA, 15 bp, Homo sapiens
ggattgctttcaaat

SEQ ID NO: 481176 - DNA, 15 bp, Homo sapiens
gattgctttcaaatg

SEQ ID NO: 481177 - DNA, 15 bp, Homo sapiens
attgctttcaaatgc

SEQ ID NO: 481178 - DNA, 15 bp, Homo sapiens
ttgctttcaaatgct

SEQ ID NO: 481179 - DNA, 15 bp, Homo sapiens
tgctttcaaatgctg

SEQ ID NO: 481180 - DNA, 15 bp, Homo sapiens
gctttcaaatgctgc

SEQ ID NO: 481181 - DNA, 15 bp, Homo sapiens
ctttcaaatgctgct

SEQ ID NO: 481182 - DNA, 15 bp, Homo sapiens
tttcaaatgctgctc

SEQ ID NO: 481183 - DNA, 15 bp, Homo sapiens
ttcaaatgctgctct

SEQ ID NO: 481184 - DNA, 15 bp, Homo sapiens
tcaaatgctgctctc

SEQ ID NO: 481185 - DNA, 15 bp, Homo sapiens
caaatgctgctctct

SEQ ID NO: 481186 - DNA, 15 bp, Homo sapiens
aaatgctgctctctg

SEQ ID NO: 481187 - DNA, 15 bp, Homo sapiens
aatgctgctctctgc

SEQ ID NO: 481188 - DNA, 15 bp, Homo sapiens
atgctgctctctgca

SEQ ID NO: 481189 - DNA, 15 bp, Homo sapiens
tgctgctctctgcag

SEQ ID NO: 481190 - DNA, 15 bp, Homo sapiens
gctgctctctgcagt

SEQ ID NO: 481191 - DNA, 15 bp, Homo sapiens
ctgctctctgcagtg

SEQ ID NO: 481192 - DNA, 15 bp, Homo sapiens
tgctctctgcagtgg

SEQ ID NO: 481193 - DNA, 15 bp, Homo sapiens
gctctctgcagtggt

SEQ ID NO: 481194 - DNA, 15 bp, Homo sapiens
ctctctgcagtggtg

SEQ ID NO: 481195 - DNA, 15 bp, Homo sapiens
tctctgcagtggtgc

SEQ ID NO: 481196 - DNA, 15 bp, Homo sapiens
ctctgcagtggtgca

SEQ ID NO: 481197 - DNA, 15 bp, Homo sapiens
tctgcagtggtgcag

SEQ ID NO: 481198 - DNA, 15 bp, Homo sapiens
ctgcagtggtgcagt

SEQ ID NO: 481199 - DNA, 15 bp, Homo sapiens
tgcagtggtgcagta

SEQ ID NO: 481200 - DNA, 15 bp, Homo sapiens
gcagtggtgcagtac

SEQ ID NO: 481201 - DNA, 15 bp, Homo sapiens
cagtggtgcagtacc

SEQ ID NO: 481202 - DNA, 15 bp, Homo sapiens
agtggtgcagtaccc

SEQ ID NO: 481203 - DNA, 15 bp, Homo sapiens
gtggtgcagtaccca

SEQ ID NO: 481204 - DNA, 15 bp, Homo sapiens
tggtgcagtacccat

SEQ ID NO: 481205 - DNA, 15 bp, Homo sapiens
ggtgcagtacccata

SEQ ID NO: 481206 - DNA, 15 bp, Homo sapiens
gtgcagtacccatac

SEQ ID NO: 481207 - DNA, 15 bp, Homo sapiens
tgcagtacccatact

SEQ ID NO: 481208 - DNA, 15 bp, Homo sapiens
gcagtacccatactc

SEQ ID NO: 481209 - DNA, 15 bp, Homo sapiens
cagtacccatactct

SEQ ID NO: 481210 - DNA, 15 bp, Homo sapiens
agtacccatactctc

SEQ ID NO: 481211 - DNA, 15 bp, Homo sapiens
gtacccatactctct

SEQ ID NO: 481212 - DNA, 15 bp, Homo sapiens
tacccatactctctt

SEQ ID NO: 481213 - DNA, 15 bp, Homo sapiens
acccatactctcttc

SEQ ID NO: 481214 - DNA, 15 bp, Homo sapiens
cccatactctcttct

SEQ ID NO: 481215 - DNA, 15 bp, Homo sapiens
ccatactctcttctt

SEQ ID NO: 481216 - DNA, 15 bp, Homo sapiens
catactctcttcttc

SEQ ID NO: 481217 - DNA, 15 bp, Homo sapiens
atactctcttcttct

SEQ ID NO: 481218 - DNA, 15 bp, Homo sapiens
tactctcttcttctc

SEQ ID NO: 481219 - DNA, 15 bp, Homo sapiens
actctcttcttctcg

SEQ ID NO: 481220 - DNA, 15 bp, Homo sapiens
ctctcttcttctcgt

SEQ ID NO: 481221 - DNA, 15 bp, Homo sapiens
tctcttcttctcgtc

SEQ ID NO: 481222 - DNA, 15 bp, Homo sapiens
ctcttcttctcgtcc

SEQ ID NO: 481223 - DNA, 15 bp, Homo sapiens
tcttcttctcgtcct

SEQ ID NO: 481224 - DNA, 15 bp, Homo sapiens
cttcttctcgtcctt

SEQ ID NO: 481225 - DNA, 15 bp, Homo sapiens
ttcttctcgtccttc

SEQ ID NO: 481226 - DNA, 15 bp, Homo sapiens
tcttctcgtccttct

SEQ ID NO: 481227 - DNA, 15 bp, Homo sapiens
cttctcgtccttcta

SEQ ID NO: 481228 - DNA, 15 bp, Homo sapiens
ttctcgtccttctaa

SEQ ID NO: 481229 - DNA, 15 bp, Homo sapiens
tctcgtccttctaaa

SEQ ID NO: 481230 - DNA, 15 bp, Homo sapiens
ctcgtccttctaaac

SEQ ID NO: 481231 - DNA, 15 bp, Homo sapiens
tcgtccttctaaacc

SEQ ID NO: 481232 - DNA, 15 bp, Homo sapiens
cgtccttctaaaccc

SEQ ID NO: 481233 - DNA, 15 bp, Homo sapiens
gtccttctaaaccca

SEQ ID NO: 481234 - DNA, 15 bp, Homo sapiens
tccttctaaacccag

SEQ ID NO: 481235 - DNA, 15 bp, Homo sapiens
ccttctaaacccagg

SEQ ID NO: 481236 - DNA, 15 bp, Homo sapiens
cttctaaacccagga

SEQ ID NO: 481237 - DNA, 15 bp, Homo sapiens
ttctaaacccaggaa

SEQ ID NO: 481238 - DNA, 15 bp, Homo sapiens
tctaaacccaggaac

SEQ ID NO: 481239 - DNA, 15 bp, Homo sapiens
ctaaacccaggaaca

SEQ ID NO: 481240 - DNA, 15 bp, Homo sapiens
taaacccaggaacaa

SEQ ID NO: 481241 - DNA, 15 bp, Homo sapiens
aaacccaggaacaag

SEQ ID NO: 481242 - DNA, 15 bp, Homo sapiens
aacccaggaacaagc

SEQ ID NO: 481243 - DNA, 15 bp, Homo sapiens
acccaggaacaagca

SEQ ID NO: 481244 - DNA, 15 bp, Homo sapiens
cccaggaacaagcat

SEQ ID NO: 481245 - DNA, 15 bp, Homo sapiens
ccaggaacaagcatg

SEQ ID NO: 481246 - DNA, 15 bp, Homo sapiens
caggaacaagcatgg

SEQ ID NO: 481247 - DNA, 15 bp, Homo sapiens
aggaacaagcatggg

SEQ ID NO: 481248 - DNA, 15 bp, Homo sapiens
ggaacaagcatgggg

SEQ ID NO: 481249 - DNA, 15 bp, Homo sapiens
gaacaagcatggggt

SEQ ID NO: 481250 - DNA, 15 bp, Homo sapiens
aacaagcatggggtt

SEQ ID NO: 481251 - DNA, 15 bp, Homo sapiens
acaagcatggggttc

SEQ ID NO: 481252 - DNA, 15 bp, Homo sapiens
caagcatggggttct

SEQ ID NO: 481253 - DNA, 15 bp, Homo sapiens
aagcatggggttctt

SEQ ID NO: 481254 - DNA, 15 bp, Homo sapiens
agcatggggttcttg

SEQ ID NO: 481255 - DNA, 15 bp, Homo sapiens
gcatggggttcttgc

SEQ ID NO: 481256 - DNA, 15 bp, Homo sapiens
catggggttcttgca

SEQ ID NO: 481257 - DNA, 15 bp, Homo sapiens
atggggttcttgcag

SEQ ID NO: 481258 - DNA, 15 bp, Homo sapiens
tggggttcttgcaga

SEQ ID NO: 481259 - DNA, 15 bp, Homo sapiens
ggggttcttgcagag

SEQ ID NO: 481260 - DNA, 15 bp, Homo sapiens
gggttcttgcagagg

SEQ ID NO: 481261 - DNA, 15 bp, Homo sapiens
ggttcttgcagaggt

SEQ ID NO: 481262 - DNA, 15 bp, Homo sapiens
gttcttgcagaggtt

SEQ ID NO: 481263 - DNA, 15 bp, Homo sapiens
ttcttgcagaggttc

SEQ ID NO: 481264 - DNA, 15 bp, Homo sapiens
tcttgcagaggttcc

SEQ ID NO: 481265 - DNA, 15 bp, Homo sapiens
cttgcagaggttcct

SEQ ID NO: 481266 - DNA, 15 bp, Homo sapiens
ttgcagaggttcctt

SEQ ID NO: 481267 - DNA, 15 bp, Homo sapiens
tgcagaggttccttc

SEQ ID NO: 481268 - DNA, 15 bp, Homo sapiens
gcagaggttccttca

SEQ ID NO: 481269 - DNA, 15 bp, Homo sapiens
cagaggttccttcat

SEQ ID NO: 481270 - DNA, 15 bp, Homo sapiens
agaggttccttcatt

SEQ ID NO: 481271 - DNA, 15 bp, Homo sapiens
gaggttccttcattc

SEQ ID NO: 481272 - DNA, 15 bp, Homo sapiens
aggttccttcattca

SEQ ID NO: 481273 - DNA, 15 bp, Homo sapiens
ggttccttcattcat

SEQ ID NO: 481274 - DNA, 15 bp, Homo sapiens
gttccttcattcatt

SEQ ID NO: 481275 - DNA, 15 bp, Homo sapiens
ttccttcattcattt

SEQ ID NO: 481276 - DNA, 15 bp, Homo sapiens
tccttcattcatttc

SEQ ID NO: 481277 - DNA, 15 bp, Homo sapiens
ccttcattcatttcc

SEQ ID NO: 481278 - DNA, 15 bp, Homo sapiens
cttcattcatttccc

SEQ ID NO: 481279 - DNA, 15 bp, Homo sapiens
ttcattcatttccca

SEQ ID NO: 481280 - DNA, 15 bp, Homo sapiens
tcattcatttcccag

SEQ ID NO: 481281 - DNA, 15 bp, Homo sapiens
cattcatttcccagt

SEQ ID NO: 481282 - DNA, 15 bp, Homo sapiens
attcatttcccagtg

SEQ ID NO: 481283 - DNA, 15 bp, Homo sapiens
ttcatttcccagtga

SEQ ID NO: 481284 - DNA, 15 bp, Homo sapiens
tcatttcccagtgat

SEQ ID NO: 481285 - DNA, 15 bp, Homo sapiens
catttcccagtgatg

SEQ ID NO: 481286 - DNA, 15 bp, Homo sapiens
atttcccagtgatgc

SEQ ID NO: 481287 - DNA, 15 bp, Homo sapiens
tttcccagtgatgct

SEQ ID NO: 481288 - DNA, 15 bp, Homo sapiens
ttcccagtgatgctg

SEQ ID NO: 481289 - DNA, 15 bp, Homo sapiens
tcccagtgatgctgc

SEQ ID NO: 481290 - DNA, 15 bp, Homo sapiens
cccagtgatgctgcg

SEQ ID NO: 481291 - DNA, 15 bp, Homo sapiens
ccagtgatgctgcgt

SEQ ID NO: 481292 - DNA, 15 bp, Homo sapiens
cagtgatgctgcgtt

SEQ ID NO: 481293 - DNA, 15 bp, Homo sapiens
agtgatgctgcgttt

SEQ ID NO: 481294 - DNA, 15 bp, Homo sapiens
gatgctgcgttttct

SEQ ID NO: 481295 - DNA, 15 bp, Homo sapiens
atgctgcgttttctc

SEQ ID NO: 481296 - DNA, 15 bp, Homo sapiens
tgctgcgttttctca

SEQ ID NO: 481297 - DNA, 15 bp, Homo sapiens
gctgcgttttctcag

SEQ ID NO: 481298 - DNA, 15 bp, Homo sapiens
ctgcgttttctcagg

SEQ ID NO: 481299 - DNA, 15 bp, Homo sapiens
tgcgttttctcagga

SEQ ID NO: 481300 - DNA, 15 bp, Homo sapiens
gcgttttctcaggaa

SEQ ID NO: 481301 - DNA, 15 bp, Homo sapiens
cgttttctcaggaaa

SEQ ID NO: 481302 - DNA, 15 bp, Homo sapiens
gttttctcaggaaag

SEQ ID NO: 481303 - DNA, 15 bp, Homo sapiens
ttttctcaggaaagg

SEQ ID NO: 481304 - DNA, 15 bp, Homo sapiens
tttctcaggaaaggg

SEQ ID NO: 481305 - DNA, 15 bp, Homo sapiens
ttctcaggaaaggga

SEQ ID NO: 481306 - DNA, 15 bp, Homo sapiens
tctcaggaaagggaa

SEQ ID NO: 481307 - DNA, 15 bp, Homo sapiens
ctcaggaaagggaat

SEQ ID NO: 481308 - DNA, 15 bp, Homo sapiens
tcaggaaagggaatc

SEQ ID NO: 481309 - DNA, 15 bp, Homo sapiens
caggaaagggaatca

SEQ ID NO: 481310 - DNA, 15 bp, Homo sapiens
aggaaagggaatcaa

SEQ ID NO: 481311 - DNA, 15 bp, Homo sapiens
ggaaagggaatcaaa

SEQ ID NO: 481312 - DNA, 15 bp, Homo sapiens
gaaagggaatcaaag

SEQ ID NO: 481313 - DNA, 15 bp, Homo sapiens
aaagggaatcaaagg

SEQ ID NO: 481314 - DNA, 15 bp, Homo sapiens
aagggaatcaaagga

SEQ ID NO: 481315 - DNA, 15 bp, Homo sapiens
agggaatcaaaggat

SEQ ID NO: 481316 - DNA, 15 bp, Homo sapiens
gggaatcaaaggata

SEQ ID NO: 481317 - DNA, 15 bp, Homo sapiens
ggaatcaaaggataa

SEQ ID NO: 481318 - DNA, 15 bp, Homo sapiens
gaatcaaaggataat

SEQ ID NO: 481319 - DNA, 15 bp, Homo sapiens
aatcaaaggataatg

SEQ ID NO: 481320 - DNA, 15 bp, Homo sapiens
atcaaaggataatgc

SEQ ID NO: 481321 - DNA, 15 bp, Homo sapiens
tcaaaggataatgcc

SEQ ID NO: 481322 - DNA, 15 bp, Homo sapiens
caaaggataatgccg

SEQ ID NO: 481323 - DNA, 15 bp, Homo sapiens
aaaggataatgccgc

SEQ ID NO: 481324 - DNA, 15 bp, Homo sapiens
aaggataatgccgca

SEQ ID NO: 481325 - DNA, 15 bp, Homo sapiens
aggataatgccgcag

SEQ ID NO: 481326 - DNA, 15 bp, Homo sapiens
ggataatgccgcagc

SEQ ID NO: 481327 - DNA, 15 bp, Homo sapiens
gataatgccgcagct

SEQ ID NO: 481328 - DNA, 15 bp, Homo sapiens
ataatgccgcagctt

SEQ ID NO: 481329 - DNA, 15 bp, Homo sapiens
taatgccgcagctta

SEQ ID NO: 481330 - DNA, 15 bp, Homo sapiens
aatgccgcagcttac

SEQ ID NO: 481331 - DNA, 15 bp, Homo sapiens
atgccgcagcttact

SEQ ID NO: 481332 - DNA, 15 bp, Homo sapiens
tgccgcagcttactt

SEQ ID NO: 481333 - DNA, 15 bp, Homo sapiens
gccgcagcttacttc

SEQ ID NO: 481334 - DNA, 15 bp, Homo sapiens
ccgcagcttacttca

SEQ ID NO: 481335 - DNA, 15 bp, Homo sapiens
cgcagcttacttcaa

SEQ ID NO: 481336 - DNA, 15 bp, Homo sapiens
gcagcttacttcaat

SEQ ID NO: 481337 - DNA, 15 bp, Homo sapiens
cagcttacttcaatc

SEQ ID NO: 481338 - DNA, 15 bp, Homo sapiens
agcttacttcaatcc

SEQ ID NO: 481339 - DNA, 15 bp, Homo sapiens
gcttacttcaatcct

SEQ ID NO: 481340 - DNA, 15 bp, Homo sapiens
cttacttcaatcctt

SEQ ID NO: 481341 - DNA, 15 bp, Homo sapiens
ttacttcaatcctta

SEQ ID NO: 481342 - DNA, 15 bp, Homo sapiens
tacttcaatccttaa

SEQ ID NO: 481343 - DNA, 15 bp, Homo sapiens
acttcaatccttaac

SEQ ID NO: 481344 - DNA, 15 bp, Homo sapiens
cttcaatccttaacc

SEQ ID NO: 481345 - DNA, 15 bp, Homo sapiens
ttcaatccttaaccc

SEQ ID NO: 481346 - DNA, 15 bp, Homo sapiens
tcaatccttaaccca

SEQ ID NO: 481347 - DNA, 15 bp, Homo sapiens
caatccttaacccac

SEQ ID NO: 481348 - DNA, 15 bp, Homo sapiens
aatccttaacccact

SEQ ID NO: 481349 - DNA, 15 bp, Homo sapiens
atccttaacccactg

SEQ ID NO: 481350 - DNA, 15 bp, Homo sapiens
tccttaacccactgg

SEQ ID NO: 481351 - DNA, 15 bp, Homo sapiens
ccttaacccactggt

SEQ ID NO: 481352 - DNA, 15 bp, Homo sapiens
cttaacccactggtg

SEQ ID NO: 481353 - DNA, 15 bp, Homo sapiens
ttaacccactggtgt

SEQ ID NO: 481354 - DNA, 15 bp, Homo sapiens
taacccactggtgtt

SEQ ID NO: 481355 - DNA, 15 bp, Homo sapiens
aacccactggtgttc

SEQ ID NO: 481356 - DNA, 15 bp, Homo sapiens
acccactggtgttcc

SEQ ID NO: 481357 - DNA, 15 bp, Homo sapiens
cccactggtgttcct

SEQ ID NO: 481358 - DNA, 15 bp, Homo sapiens
ccactggtgttcctt

SEQ ID NO: 481359 - DNA, 15 bp, Homo sapiens
cactggtgttcctta

SEQ ID NO: 481360 - DNA, 15 bp, Homo sapiens
actggtgttccttat

SEQ ID NO: 481361 - DNA, 15 bp, Homo sapiens
ctggtgttccttatt

SEQ ID NO: 481362 - DNA, 15 bp, Homo sapiens
tggtgttccttattt

SEQ ID NO: 481363 - DNA, 15 bp, Homo sapiens
ggtgttccttatttc

SEQ ID NO: 481364 - DNA, 15 bp, Homo sapiens
gtgttccttatttcc

SEQ ID NO: 481365 - DNA, 15 bp, Homo sapiens
tgttccttatttcca

SEQ ID NO: 481366 - DNA, 15 bp, Homo sapiens
gttccttatttccag

SEQ ID NO: 481367 - DNA, 15 bp, Homo sapiens
ttccttatttccagt

SEQ ID NO: 481368 - DNA, 15 bp, Homo sapiens
tccttatttccagtt

SEQ ID NO: 481369 - DNA, 15 bp, Homo sapiens
ccttatttccagttg

SEQ ID NO: 481370 - DNA, 15 bp, Homo sapiens
cttatttccagttgc

SEQ ID NO: 481371 - DNA, 15 bp, Homo sapiens
ttatttccagttgct

SEQ ID NO: 481372 - DNA, 15 bp, Homo sapiens
tatttccagttgcta

SEQ ID NO: 481373 - DNA, 15 bp, Homo sapiens
atttccagttgctaa

SEQ ID NO: 481374 - DNA, 15 bp, Homo sapiens
tttccagttgctaac

SEQ ID NO: 481375 - DNA, 15 bp, Homo sapiens
ttccagttgctaact

SEQ ID NO: 481376 - DNA, 15 bp, Homo sapiens
tccagttgctaactg

SEQ ID NO: 481377 - DNA, 15 bp, Homo sapiens
ccagttgctaactgt

SEQ ID NO: 481378 - DNA, 15 bp, Homo sapiens
cagttgctaactgtg

SEQ ID NO: 481379 - DNA, 15 bp, Homo sapiens
agttgctaactgtgt

SEQ ID NO: 481380 - DNA, 15 bp, Homo sapiens
gttgctaactgtgtt

SEQ ID NO: 481381 - DNA, 15 bp, Homo sapiens
ttgctaactgtgttg

SEQ ID NO: 481382 - DNA, 15 bp, Homo sapiens
tgctaactgtgttgt

SEQ ID NO: 481383 - DNA, 15 bp, Homo sapiens
gctaactgtgttgta

SEQ ID NO: 481384 - DNA, 15 bp, Homo sapiens
ctaactgtgttgtaa

SEQ ID NO: 481385 - DNA, 15 bp, Homo sapiens
taactgtgttgtaag

SEQ ID NO: 481386 - DNA, 15 bp, Homo sapiens
aactgtgttgtaagg

SEQ ID NO: 481387 - DNA, 15 bp, Homo sapiens
actgtgttgtaaggg

SEQ ID NO: 481388 - DNA, 15 bp, Homo sapiens
ctgtgttgtaagggt

SEQ ID NO: 481389 - DNA, 15 bp, Homo sapiens
tgtgttgtaagggtc

SEQ ID NO: 481390 - DNA, 15 bp, Homo sapiens
gtgttgtaagggtcc

SEQ ID NO: 481391 - DNA, 15 bp, Homo sapiens
tgttgtaagggtccc

SEQ ID NO: 481392 - DNA, 15 bp, Homo sapiens
gttgtaagggtccca

SEQ ID NO: 481393 - DNA, 15 bp, Homo sapiens
ttgtaagggtcccac

SEQ ID NO: 481394 - DNA, 15 bp, Homo sapiens
tgtaagggtcccacc

SEQ ID NO: 481395 - DNA, 15 bp, Homo sapiens
gtaagggtcccaccc

SEQ ID NO: 481396 - DNA, 15 bp, Homo sapiens
taagggtcccacccc

SEQ ID NO: 481397 - DNA, 15 bp, Homo sapiens
aagggtcccacccca

SEQ ID NO: 481398 - DNA, 15 bp, Homo sapiens
agggtcccaccccat

SEQ ID NO: 481399 - DNA, 15 bp, Homo sapiens
gggtcccaccccatc

SEQ ID NO: 481400 - DNA, 15 bp, Homo sapiens
ggtcccaccccatcc

SEQ ID NO: 481401 - DNA, 15 bp, Homo sapiens
gtcccaccccatcct

SEQ ID NO: 481402 - DNA, 15 bp, Homo sapiens
tcccaccccatcctc

SEQ ID NO: 481403 - DNA, 15 bp, Homo sapiens
cccaccccatcctct

SEQ ID NO: 481404 - DNA, 15 bp, Homo sapiens
ccaccccatcctctt

SEQ ID NO: 481405 - DNA, 15 bp, Homo sapiens
caccccatcctcttt

SEQ ID NO: 481406 - DNA, 15 bp, Homo sapiens
accccatcctctttt

SEQ ID NO: 481407 - DNA, 15 bp, Homo sapiens
ccccatcctctttta

SEQ ID NO: 481408 - DNA, 15 bp, Homo sapiens
cccatcctcttttaa

SEQ ID NO: 481409 - DNA, 15 bp, Homo sapiens
ccatcctcttttaaa

SEQ ID NO: 481410 - DNA, 15 bp, Homo sapiens
catcctcttttaaaa

SEQ ID NO: 481411 - DNA, 15 bp, Homo sapiens
atcctcttttaaaat

SEQ ID NO: 481412 - DNA, 15 bp, Homo sapiens
tcctcttttaaaatt

SEQ ID NO: 481413 - DNA, 15 bp, Homo sapiens
cctcttttaaaattt

SEQ ID NO: 481414 - DNA, 15 bp, Homo sapiens
ctcttttaaaattta

SEQ ID NO: 481415 - DNA, 15 bp, Homo sapiens
tcttttaaaatttat

SEQ ID NO: 481416 - DNA, 15 bp, Homo sapiens
cttttaaaatttatt

SEQ ID NO: 481417 - DNA, 15 bp, Homo sapiens
ttttaaaatttattt

SEQ ID NO: 481418 - DNA, 15 bp, Homo sapiens
tttaaaatttatttg

SEQ ID NO: 481419 - DNA, 15 bp, Homo sapiens
ttaaaatttatttga

SEQ ID NO: 481420 - DNA, 15 bp, Homo sapiens
taaaatttatttgat

SEQ ID NO: 481421 - DNA, 15 bp, Homo sapiens
aaaatttatttgata

SEQ ID NO: 481422 - DNA, 15 bp, Homo sapiens
aaatttatttgataa

SEQ ID NO: 481423 - DNA, 15 bp, Homo sapiens
aatttatttgataaa

SEQ ID NO: 481424 - DNA, 15 bp, Homo sapiens
atttatttgataaaa

SEQ ID NO: 481425 - DNA, 15 bp, Homo sapiens
tttatttgataaaag

SEQ ID NO: 481426 - DNA, 15 bp, Homo sapiens
ttatttgataaaagc

SEQ ID NO: 481427 - DNA, 15 bp, Homo sapiens
tatttgataaaagca

SEQ ID NO: 481428 - DNA, 15 bp, Homo sapiens
atttgataaaagcaa

SEQ ID NO: 481429 - DNA, 15 bp, Homo sapiens
tttgataaaagcaag

SEQ ID NO: 481430 - DNA, 15 bp, Homo sapiens
ttgataaaagcaaga

SEQ ID NO: 481431 - DNA, 15 bp, Homo sapiens
tgataaaagcaagaa

SEQ ID NO: 481432 - DNA, 15 bp, Homo sapiens
gataaaagcaagaag

SEQ ID NO: 481433 - DNA, 15 bp, Homo sapiens
ataaaagcaagaagg

SEQ ID NO: 481434 - DNA, 15 bp, Homo sapiens
taaaagcaagaaggt

SEQ ID NO: 481435 - DNA, 15 bp, Homo sapiens
aaaagcaagaaggtc

SEQ ID NO: 481436 - DNA, 15 bp, Homo sapiens
aaagcaagaaggtca

SEQ ID NO: 481437 - DNA, 15 bp, Homo sapiens
aagcaagaaggtcag

SEQ ID NO: 481438 - DNA, 15 bp, Homo sapiens
agcaagaaggtcagg

SEQ ID NO: 481439 - DNA, 15 bp, Homo sapiens
gcaagaaggtcaggt

SEQ ID NO: 481440 - DNA, 15 bp, Homo sapiens
caagaaggtcaggtt

SEQ ID NO: 481441 - DNA, 15 bp, Homo sapiens
aagaaggtcaggtta

SEQ ID NO: 481442 - DNA, 15 bp, Homo sapiens
agaaggtcaggttag

SEQ ID NO: 481443 - DNA, 15 bp, Homo sapiens
gaaggtcaggttagg

SEQ ID NO: 481444 - DNA, 15 bp, Homo sapiens
aaggtcaggttaggt

SEQ ID NO: 481445 - DNA, 15 bp, Homo sapiens
aggtcaggttaggta

SEQ ID NO: 481446 - DNA, 15 bp, Homo sapiens
ggtcaggttaggtac

SEQ ID NO: 481447 - DNA, 15 bp, Homo sapiens
gtcaggttaggtact

SEQ ID NO: 481448 - DNA, 15 bp, Homo sapiens
tcaggttaggtactt

SEQ ID NO: 481449 - DNA, 15 bp, Homo sapiens
caggttaggtactta

SEQ ID NO: 481450 - DNA, 15 bp, Homo sapiens
aggttaggtacttat

SEQ ID NO: 481451 - DNA, 15 bp, Homo sapiens
ggttaggtacttatt

SEQ ID NO: 481452 - DNA, 15 bp, Homo sapiens
gttaggtacttatta

SEQ ID NO: 481453 - DNA, 15 bp, Homo sapiens
ttaggtacttattat

SEQ ID NO: 481454 - DNA, 15 bp, Homo sapiens
taggtacttattatt

SEQ ID NO: 481455 - DNA, 15 bp, Homo sapiens
aggtacttattatta

SEQ ID NO: 481456 - DNA, 15 bp, Homo sapiens
ggtacttattattat

SEQ ID NO: 481457 - DNA, 15 bp, Homo sapiens
gtacttattattata

SEQ ID NO: 481458 - DNA, 15 bp, Homo sapiens
tacttattattatat

SEQ ID NO: 481459 - DNA, 15 bp, Homo sapiens
acttattattatatt

SEQ ID NO: 481460 - DNA, 15 bp, Homo sapiens
cttattattatattg

SEQ ID NO: 481461 - DNA, 15 bp, Homo sapiens
ttattattatattgt

SEQ ID NO: 481462 - DNA, 15 bp, Homo sapiens
tattattatattgtg

SEQ ID NO: 481463 - DNA, 15 bp, Homo sapiens
attattatattgtgg

SEQ ID NO: 481464 - DNA, 15 bp, Homo sapiens
ttattatattgtggc

SEQ ID NO: 481465 - DNA, 15 bp, Homo sapiens
tattatattgtggcc

SEQ ID NO: 481466 - DNA, 15 bp, Homo sapiens
attatattgtggcct

SEQ ID NO: 481467 - DNA, 15 bp, Homo sapiens
ttatattgtggcctt

SEQ ID NO: 481468 - DNA, 15 bp, Homo sapiens
tatattgtggcctta

SEQ ID NO: 481469 - DNA, 15 bp, Homo sapiens
atattgtggccttaa

SEQ ID NO: 481470 - DNA, 15 bp, Homo sapiens
tattgtggccttaac

SEQ ID NO: 481471 - DNA, 15 bp, Homo sapiens
attgtggccttaacc

SEQ ID NO: 481472 - DNA, 15 bp, Homo sapiens
ttgtggccttaacca

SEQ ID NO: 481473 - DNA, 15 bp, Homo sapiens
tgtggccttaaccaa

SEQ ID NO: 481474 - DNA, 15 bp, Homo sapiens
gtggccttaaccaaa

SEQ ID NO: 481475 - DNA, 15 bp, Homo sapiens
tggccttaaccaaag

SEQ ID NO: 481476 - DNA, 15 bp, Homo sapiens
ggccttaaccaaagt

SEQ ID NO: 481477 - DNA, 15 bp, Homo sapiens
gccttaaccaaagta

SEQ ID NO: 481478 - DNA, 15 bp, Homo sapiens
ccttaaccaaagtat

SEQ ID NO: 481479 - DNA, 15 bp, Homo sapiens
cttaaccaaagtata

SEQ ID NO: 481480 - DNA, 15 bp, Homo sapiens
ttaaccaaagtatat

SEQ ID NO: 481481 - DNA, 15 bp, Homo sapiens
taaccaaagtatatg

SEQ ID NO: 481482 - DNA, 15 bp, Homo sapiens
aaccaaagtatatga

SEQ ID NO: 481483 - DNA, 15 bp, Homo sapiens
accaaagtatatgac

SEQ ID NO: 481484 - DNA, 15 bp, Homo sapiens
ccaaagtatatgacc

SEQ ID NO: 481485 - DNA, 15 bp, Homo sapiens
caaagtatatgacct

SEQ ID NO: 481486 - DNA, 15 bp, Homo sapiens
aaagtatatgacctt

SEQ ID NO: 481487 - DNA, 15 bp, Homo sapiens
aagtatatgaccttt

SEQ ID NO: 481488 - DNA, 15 bp, Homo sapiens
agtatatgaccttta

SEQ ID NO: 481489 - DNA, 15 bp, Homo sapiens
gtatatgacctttat

SEQ ID NO: 481490 - DNA, 15 bp, Homo sapiens
tatatgacctttatt

SEQ ID NO: 481491 - DNA, 15 bp, Homo sapiens
atatgacctttattt

SEQ ID NO: 481492 - DNA, 15 bp, Homo sapiens
tatgacctttattta

SEQ ID NO: 481493 - DNA, 15 bp, Homo sapiens
atgacctttatttaa

SEQ ID NO: 481494 - DNA, 15 bp, Homo sapiens
tgacctttatttaaa

SEQ ID NO: 481495 - DNA, 15 bp, Homo sapiens
gacctttatttaaat

SEQ ID NO: 481496 - DNA, 15 bp, Homo sapiens
acctttatttaaata

SEQ ID NO: 481497 - DNA, 15 bp, Homo sapiens
cctttatttaaatat

SEQ ID NO: 481498 - DNA, 15 bp, Homo sapiens
ctttatttaaatata

SEQ ID NO: 481499 - DNA, 15 bp, Homo sapiens
tttatttaaatatat

SEQ ID NO: 481500 - DNA, 15 bp, Homo sapiens
ttatttaaatatata

SEQ ID NO: 481501 - DNA, 15 bp, Homo sapiens
tatttaaatatatat

SEQ ID NO: 481502 - DNA, 15 bp, Homo sapiens
atttaaatatatata

SEQ ID NO: 481503 - DNA, 15 bp, Homo sapiens
tttaaatatatatat

SEQ ID NO: 481504 - DNA, 15 bp, Homo sapiens
ttaaatatatatata

SEQ ID NO: 481505 - DNA, 15 bp, Homo sapiens
taaatatatatatac

SEQ ID NO: 481506 - DNA, 15 bp, Homo sapiens
aaatatatatatact

SEQ ID NO: 481507 - DNA, 15 bp, Homo sapiens
aatatatatatactc

SEQ ID NO: 481508 - DNA, 15 bp, Homo sapiens
atatatatatactca

SEQ ID NO: 481509 - DNA, 15 bp, Homo sapiens
tatatatatactcac

SEQ ID NO: 481510 - DNA, 15 bp, Homo sapiens
atatatatactcaca

SEQ ID NO: 481511 - DNA, 15 bp, Homo sapiens
tatatatactcacat

SEQ ID NO: 481512 - DNA, 15 bp, Homo sapiens
atatatactcacata

SEQ ID NO: 481513 - DNA, 15 bp, Homo sapiens
tatatactcacatac

SEQ ID NO: 481514 - DNA, 15 bp, Homo sapiens
atatactcacataca

SEQ ID NO: 481515 - DNA, 15 bp, Homo sapiens
tatactcacatacac

SEQ ID NO: 481516 - DNA, 15 bp, Homo sapiens
atactcacatacaca

SEQ ID NO: 481517 - DNA, 15 bp, Homo sapiens
tactcacatacacac

SEQ ID NO: 481518 - DNA, 15 bp, Homo sapiens
actcacatacacaca

SEQ ID NO: 481519 - DNA, 15 bp, Homo sapiens
ctcacatacacacat

SEQ ID NO: 481520 - DNA, 15 bp, Homo sapiens
tcacatacacacatg

SEQ ID NO: 481521 - DNA, 15 bp, Homo sapiens
cacatacacacatgt

SEQ ID NO: 481522 - DNA, 15 bp, Homo sapiens
acatacacacatgtt

SEQ ID NO: 481523 - DNA, 15 bp, Homo sapiens
catacacacatgttc

SEQ ID NO: 481524 - DNA, 15 bp, Homo sapiens
atacacacatgttca

SEQ ID NO: 481525 - DNA, 15 bp, Homo sapiens
tacacacatgttcat

SEQ ID NO: 481526 - DNA, 15 bp, Homo sapiens
acacacatgttcata

SEQ ID NO: 481527 - DNA, 15 bp, Homo sapiens
cacacatgttcatat

SEQ ID NO: 481528 - DNA, 15 bp, Homo sapiens
acacatgttcatatc

SEQ ID NO: 481529 - DNA, 15 bp, Homo sapiens
cacatgttcatatct

SEQ ID NO: 481530 - DNA, 15 bp, Homo sapiens
acatgttcatatcta

SEQ ID NO: 481531 - DNA, 15 bp, Homo sapiens
catgttcatatctat

SEQ ID NO: 481532 - DNA, 15 bp, Homo sapiens
atgttcatatctata

SEQ ID NO: 481533 - DNA, 15 bp, Homo sapiens
tgttcatatctatat

SEQ ID NO: 481534 - DNA, 15 bp, Homo sapiens
gttcatatctatatc

SEQ ID NO: 481535 - DNA, 15 bp, Homo sapiens
ttcatatctatatct

SEQ ID NO: 481536 - DNA, 15 bp, Homo sapiens
tcatatctatatcta

SEQ ID NO: 481537 - DNA, 15 bp, Homo sapiens
catatctatatctat

SEQ ID NO: 481538 - DNA, 15 bp, Homo sapiens
atatctatatctata

SEQ ID NO: 481539 - DNA, 15 bp, Homo sapiens
tatctatatctatat

SEQ ID NO: 481540 - DNA, 15 bp, Homo sapiens
atctatatctatata

SEQ ID NO: 481541 - DNA, 15 bp, Homo sapiens
tctatatctatatat

SEQ ID NO: 481542 - DNA, 15 bp, Homo sapiens
ctatatctatatatt

SEQ ID NO: 481543 - DNA, 15 bp, Homo sapiens
atatctatatatttc

SEQ ID NO: 481544 - DNA, 15 bp, Homo sapiens
tatctatatatttct

SEQ ID NO: 481545 - DNA, 15 bp, Homo sapiens
atctatatatttcta

SEQ ID NO: 481546 - DNA, 15 bp, Homo sapiens
tctatatatttctag

SEQ ID NO: 481547 - DNA, 15 bp, Homo sapiens
ctatatatttctaga

SEQ ID NO: 481548 - DNA, 15 bp, Homo sapiens
tatatatttctagag

SEQ ID NO: 481549 - DNA, 15 bp, Homo sapiens
tatatttctagaggg

SEQ ID NO: 481550 - DNA, 15 bp, Homo sapiens
atatttctagaggga

SEQ ID NO: 481551 - DNA, 15 bp, Homo sapiens
tatttctagagggag

SEQ ID NO: 481552 - DNA, 15 bp, Homo sapiens
atttctagagggaga

SEQ ID NO: 481553 - DNA, 15 bp, Homo sapiens
tttctagagggagag

SEQ ID NO: 481554 - DNA, 15 bp, Homo sapiens
ttctagagggagaga

SEQ ID NO: 481555 - DNA, 15 bp, Homo sapiens
tctagagggagagaa

SEQ ID NO: 481556 - DNA, 15 bp, Homo sapiens
ctagagggagagaaa

SEQ ID NO: 481557 - DNA, 15 bp, Homo sapiens
tagagggagagaaaa

SEQ ID NO: 481558 - DNA, 15 bp, Homo sapiens
agagggagagaaaaa

SEQ ID NO: 481559 - DNA, 15 bp, Homo sapiens
gagggagagaaaaag

SEQ ID NO: 481560 - DNA, 15 bp, Homo sapiens
agggagagaaaaaga

SEQ ID NO: 481561 - DNA, 15 bp, Homo sapiens
gggagagaaaaagag

SEQ ID NO: 481562 - DNA, 15 bp, Homo sapiens
ggagagaaaaagaga

SEQ ID NO: 481563 - DNA, 15 bp, Homo sapiens
gagagaaaaagagag

SEQ ID NO: 481564 - DNA, 15 bp, Homo sapiens
agagaaaaagagagg

SEQ ID NO: 481565 - DNA, 15 bp, Homo sapiens
gagaaaaagagaggg

SEQ ID NO: 481566 - DNA, 15 bp, Homo sapiens
agaaaaagagagggg

SEQ ID NO: 481567 - DNA, 15 bp, Homo sapiens
gaaaaagagaggggg

SEQ ID NO: 481568 - DNA, 15 bp, Homo sapiens
aaaaagagagggggt

SEQ ID NO: 481569 - DNA, 15 bp, Homo sapiens
aaaagagagggggtt

SEQ ID NO: 481570 - DNA, 15 bp, Homo sapiens
aaagagagggggttt

SEQ ID NO: 481571 - DNA, 15 bp, Homo sapiens
aagagagggggttta

SEQ ID NO: 481572 - DNA, 15 bp, Homo sapiens
agagagggggtttat

SEQ ID NO: 481573 - DNA, 15 bp, Homo sapiens
gagagggggtttatt

SEQ ID NO: 481574 - DNA, 15 bp, Homo sapiens
agagggggtttattg

SEQ ID NO: 481575 - DNA, 15 bp, Homo sapiens
gagggggtttattga

SEQ ID NO: 481576 - DNA, 15 bp, Homo sapiens
agggggtttattgat

SEQ ID NO: 481577 - DNA, 15 bp, Homo sapiens
gggggtttattgatg

SEQ ID NO: 481578 - DNA, 15 bp, Homo sapiens
ggggtttattgatga

SEQ ID NO: 481579 - DNA, 15 bp, Homo sapiens
gggtttattgatgaa

SEQ ID NO: 481580 - DNA, 15 bp, Homo sapiens
ggtttattgatgaag

SEQ ID NO: 481581 - DNA, 15 bp, Homo sapiens
gtttattgatgaaga

SEQ ID NO: 481582 - DNA, 15 bp, Homo sapiens
tttattgatgaagaa

SEQ ID NO: 481583 - DNA, 15 bp, Homo sapiens
ttattgatgaagaaa

SEQ ID NO: 481584 - DNA, 15 bp, Homo sapiens
tattgatgaagaaag

SEQ ID NO: 481585 - DNA, 15 bp, Homo sapiens
attgatgaagaaagc

SEQ ID NO: 481586 - DNA, 15 bp, Homo sapiens
ttgatgaagaaagca

SEQ ID NO: 481587 - DNA, 15 bp, Homo sapiens
tgatgaagaaagcaa

SEQ ID NO: 481588 - DNA, 15 bp, Homo sapiens
gatgaagaaagcaaa

SEQ ID NO: 481589 - DNA, 15 bp, Homo sapiens
atgaagaaagcaaaa

SEQ ID NO: 481590 - DNA, 15 bp, Homo sapiens
tgaagaaagcaaaat

SEQ ID NO: 481591 - DNA, 15 bp, Homo sapiens
gaagaaagcaaaata

SEQ ID NO: 481592 - DNA, 15 bp, Homo sapiens
aagaaagcaaaataa

SEQ ID NO: 481593 - DNA, 15 bp, Homo sapiens
agaaagcaaaataaa

SEQ ID NO: 481594 - DNA, 15 bp, Homo sapiens
gaaagcaaaataaat

SEQ ID NO: 481595 - DNA, 15 bp, Homo sapiens
aaagcaaaataaatc

SEQ ID NO: 481596 - DNA, 15 bp, Homo sapiens
aagcaaaataaatca

SEQ ID NO: 481597 - DNA, 15 bp, Homo sapiens
agcaaaataaatcaa

SEQ ID NO: 481598 - DNA, 15 bp, Homo sapiens
gcaaaataaatcaac

SEQ ID NO: 481599 - DNA, 15 bp, Homo sapiens
caaaataaatcaaca

SEQ ID NO: 481600 - DNA, 15 bp, Homo sapiens
aaaataaatcaacaa

SEQ ID NO: 481601 - DNA, 15 bp, Homo sapiens
aaataaatcaacaag

SEQ ID NO: 481602 - DNA, 15 bp, Homo sapiens
aataaatcaacaagt

SEQ ID NO: 481603 - DNA, 15 bp, Homo sapiens
ataaatcaacaagtg

SEQ ID NO: 481604 - DNA, 15 bp, Homo sapiens
taaatcaacaagtgg

SEQ ID NO: 481605 - DNA, 15 bp, Homo sapiens
aaatcaacaagtggc

SEQ ID NO: 481606 - DNA, 15 bp, Homo sapiens
aatcaacaagtggca

SEQ ID NO: 481607 - DNA, 15 bp, Homo sapiens
atcaacaagtggcac

SEQ ID NO: 481608 - DNA, 15 bp, Homo sapiens
tcaacaagtggcaca

SEQ ID NO: 481609 - DNA, 15 bp, Homo sapiens
caacaagtggcacat

SEQ ID NO: 481610 - DNA, 15 bp, Homo sapiens
aacaagtggcacatc

SEQ ID NO: 481611 - DNA, 15 bp, Homo sapiens
acaagtggcacatct

SEQ ID NO: 481612 - DNA, 15 bp, Homo sapiens
caagtggcacatctg

SEQ ID NO: 481613 - DNA, 15 bp, Homo sapiens
aagtggcacatctga

SEQ ID NO: 481614 - DNA, 15 bp, Homo sapiens
agtggcacatctgaa

SEQ ID NO: 481615 - DNA, 15 bp, Homo sapiens
gtggcacatctgaac

SEQ ID NO: 481616 - DNA, 15 bp, Homo sapiens
tggcacatctgaact

SEQ ID NO: 481617 - DNA, 15 bp, Homo sapiens
ggcacatctgaactt

SEQ ID NO: 481618 - DNA, 15 bp, Homo sapiens
gcacatctgaacttt

SEQ ID NO: 481619 - DNA, 15 bp, Homo sapiens
cacatctgaactttt

SEQ ID NO: 481620 - DNA, 15 bp, Homo sapiens
acatctgaacttttg

SEQ ID NO: 481621 - DNA, 15 bp, Homo sapiens
catctgaacttttgc

SEQ ID NO: 481622 - DNA, 15 bp, Homo sapiens
atctgaacttttgct

SEQ ID NO: 481623 - DNA, 15 bp, Homo sapiens
tctgaacttttgctt

SEQ ID NO: 481624 - DNA, 15 bp, Homo sapiens
ctgaacttttgcttt

SEQ ID NO: 481625 - DNA, 15 bp, Homo sapiens
tgaacttttgctttg

SEQ ID NO: 481626 - DNA, 15 bp, Homo sapiens
gaacttttgctttgg

SEQ ID NO: 481627 - DNA, 15 bp, Homo sapiens
aacttttgctttggc

SEQ ID NO: 481628 - DNA, 15 bp, Homo sapiens
acttttgctttggct

SEQ ID NO: 481629 - DNA, 15 bp, Homo sapiens
cttttgctttggctg

SEQ ID NO: 481630 - DNA, 15 bp, Homo sapiens
ttttgctttggctgt

SEQ ID NO: 481631 - DNA, 15 bp, Homo sapiens
tttgctttggctgtt

SEQ ID NO: 481632 - DNA, 15 bp, Homo sapiens
ttgctttggctgttt

SEQ ID NO: 481633 - DNA, 15 bp, Homo sapiens
tgctttggctgtttg

SEQ ID NO: 481634 - DNA, 15 bp, Homo sapiens
gctttggctgtttga

SEQ ID NO: 481635 - DNA, 15 bp, Homo sapiens
ctttggctgtttgac

SEQ ID NO: 481636 - DNA, 15 bp, Homo sapiens
tttggctgtttgaca

SEQ ID NO: 481637 - DNA, 15 bp, Homo sapiens
ttggctgtttgacaa

SEQ ID NO: 481638 - DNA, 15 bp, Homo sapiens
tggctgtttgacaag

SEQ ID NO: 481639 - DNA, 15 bp, Homo sapiens
ggctgtttgacaagc

SEQ ID NO: 481640 - DNA, 15 bp, Homo sapiens
gctgtttgacaagca

SEQ ID NO: 481641 - DNA, 15 bp, Homo sapiens
ctgtttgacaagcat

SEQ ID NO: 481642 - DNA, 15 bp, Homo sapiens
tgtttgacaagcata

SEQ ID NO: 481643 - DNA, 15 bp, Homo sapiens
gtttgacaagcataa

SEQ ID NO: 481644 - DNA, 15 bp, Homo sapiens
tttgacaagcataat

SEQ ID NO: 481645 - DNA, 15 bp, Homo sapiens
ttgacaagcataata

SEQ ID NO: 481646 - DNA, 15 bp, Homo sapiens
tgacaagcataatac

SEQ ID NO: 481647 - DNA, 15 bp, Homo sapiens
gacaagcataatacc

SEQ ID NO: 481648 - DNA, 15 bp, Homo sapiens
acaagcataatacca

SEQ ID NO: 481649 - DNA, 15 bp, Homo sapiens
caagcataataccag

SEQ ID NO: 481650 - DNA, 15 bp, Homo sapiens
aagcataataccaga

SEQ ID NO: 481651 - DNA, 15 bp, Homo sapiens
agcataataccagaa

SEQ ID NO: 481652 - DNA, 15 bp, Homo sapiens
gcataataccagaac

SEQ ID NO: 481653 - DNA, 15 bp, Homo sapiens
cataataccagaacg

SEQ ID NO: 481654 - DNA, 15 bp, Homo sapiens
ataataccagaacgt

SEQ ID NO: 481655 - DNA, 15 bp, Homo sapiens
taataccagaacgtt

SEQ ID NO: 481656 - DNA, 15 bp, Homo sapiens
aataccagaacgttc

SEQ ID NO: 481657 - DNA, 15 bp, Homo sapiens
ataccagaacgttca

SEQ ID NO: 481658 - DNA, 15 bp, Homo sapiens
taccagaacgttcag

SEQ ID NO: 481659 - DNA, 15 bp, Homo sapiens
accagaacgttcagt

SEQ ID NO: 481660 - DNA, 15 bp, Homo sapiens
ccagaacgttcagtt

SEQ ID NO: 481661 - DNA, 15 bp, Homo sapiens
cagaacgttcagttt

SEQ ID NO: 481662 - DNA, 15 bp, Homo sapiens
agaacgttcagtttt

SEQ ID NO: 481663 - DNA, 15 bp, Homo sapiens
gaacgttcagttttc

SEQ ID NO: 481664 - DNA, 15 bp, Homo sapiens
aacgttcagttttct

SEQ ID NO: 481665 - DNA, 15 bp, Homo sapiens
acgttcagttttctc

SEQ ID NO: 481666 - DNA, 15 bp, Homo sapiens
cgttcagttttctca

SEQ ID NO: 481667 - DNA, 15 bp, Homo sapiens
gttcagttttctcaa

SEQ ID NO: 481668 - DNA, 15 bp, Homo sapiens
ttcagttttctcaat

SEQ ID NO: 481669 - DNA, 15 bp, Homo sapiens
tcagttttctcaatt

SEQ ID NO: 481670 - DNA, 15 bp, Homo sapiens
cagttttctcaattg

SEQ ID NO: 481671 - DNA, 15 bp, Homo sapiens
agttttctcaattgc

SEQ ID NO: 481672 - DNA, 15 bp, Homo sapiens
gttttctcaattgct

SEQ ID NO: 481673 - DNA, 15 bp, Homo sapiens
ttttctcaattgctt

SEQ ID NO: 481674 - DNA, 15 bp, Homo sapiens
tttctcaattgcttc

SEQ ID NO: 481675 - DNA, 15 bp, Homo sapiens
ttctcaattgcttca

SEQ ID NO: 481676 - DNA, 15 bp, Homo sapiens
tctcaattgcttcat

SEQ ID NO: 481677 - DNA, 15 bp, Homo sapiens
ctcaattgcttcatc

SEQ ID NO: 481678 - DNA, 15 bp, Homo sapiens
tcaattgcttcatct

SEQ ID NO: 481679 - DNA, 15 bp, Homo sapiens
caattgcttcatcta

SEQ ID NO: 481680 - DNA, 15 bp, Homo sapiens
aattgcttcatctag

SEQ ID NO: 481681 - DNA, 15 bp, Homo sapiens
attgcttcatctagc

SEQ ID NO: 481682 - DNA, 15 bp, Homo sapiens
ttgcttcatctagct

SEQ ID NO: 481683 - DNA, 15 bp, Homo sapiens
tgcttcatctagctc

SEQ ID NO: 481684 - DNA, 15 bp, Homo sapiens
gcttcatctagctct

SEQ ID NO: 481685 - DNA, 15 bp, Homo sapiens
cttcatctagctctc

SEQ ID NO: 481686 - DNA, 15 bp, Homo sapiens
ttcatctagctctct

SEQ ID NO: 481687 - DNA, 15 bp, Homo sapiens
tcatctagctctctg

SEQ ID NO: 481688 - DNA, 15 bp, Homo sapiens
catctagctctctga

SEQ ID NO: 481689 - DNA, 15 bp, Homo sapiens
atctagctctctgat

SEQ ID NO: 481690 - DNA, 15 bp, Homo sapiens
tctagctctctgatc

SEQ ID NO: 481691 - DNA, 15 bp, Homo sapiens
ctagctctctgatct

SEQ ID NO: 481692 - DNA, 15 bp, Homo sapiens
tagctctctgatctc

SEQ ID NO: 481693 - DNA, 15 bp, Homo sapiens
agctctctgatctca

SEQ ID NO: 481694 - DNA, 15 bp, Homo sapiens
gctctctgatctcaa

SEQ ID NO: 481695 - DNA, 15 bp, Homo sapiens
ctctctgatctcaat

SEQ ID NO: 481696 - DNA, 15 bp, Homo sapiens
tctctgatctcaatg

SEQ ID NO: 481697 - DNA, 15 bp, Homo sapiens
ctctgatctcaatgc

SEQ ID NO: 481698 - DNA, 15 bp, Homo sapiens
tctgatctcaatgct

SEQ ID NO: 481699 - DNA, 15 bp, Homo sapiens
ctgatctcaatgctt

SEQ ID NO: 481700 - DNA, 15 bp, Homo sapiens
tgatctcaatgctta

SEQ ID NO: 481701 - DNA, 15 bp, Homo sapiens
gatctcaatgcttag

SEQ ID NO: 481702 - DNA, 15 bp, Homo sapiens
atctcaatgcttagg

SEQ ID NO: 481703 - DNA, 15 bp, Homo sapiens
tctcaatgcttagga

SEQ ID NO: 481704 - DNA, 15 bp, Homo sapiens
ctcaatgcttaggat

SEQ ID NO: 481705 - DNA, 15 bp, Homo sapiens
tcaatgcttaggata

SEQ ID NO: 481706 - DNA, 15 bp, Homo sapiens
caatgcttaggataa

SEQ ID NO: 481707 - DNA, 15 bp, Homo sapiens
aatgcttaggataaa

SEQ ID NO: 481708 - DNA, 15 bp, Homo sapiens
atgcttaggataaac

SEQ ID NO: 481709 - DNA, 15 bp, Homo sapiens
tgcttaggataaacc

SEQ ID NO: 481710 - DNA, 15 bp, Homo sapiens
gcttaggataaacct

SEQ ID NO: 481711 - DNA, 15 bp, Homo sapiens
cttaggataaacctt

SEQ ID NO: 481712 - DNA, 15 bp, Homo sapiens
ttaggataaaccttt

SEQ ID NO: 481713 - DNA, 15 bp, Homo sapiens
taggataaacctttt

SEQ ID NO: 481714 - DNA, 15 bp, Homo sapiens
aggataaaccttttc

SEQ ID NO: 481715 - DNA, 15 bp, Homo sapiens
ggataaaccttttct

SEQ ID NO: 481716 - DNA, 15 bp, Homo sapiens
gataaaccttttcta

SEQ ID NO: 481717 - DNA, 15 bp, Homo sapiens
ataaaccttttctag

SEQ ID NO: 481718 - DNA, 15 bp, Homo sapiens
taaaccttttctagg

SEQ ID NO: 481719 - DNA, 15 bp, Homo sapiens
aaaccttttctagga

SEQ ID NO: 481720 - DNA, 15 bp, Homo sapiens
aaccttttctaggaa

SEQ ID NO: 481721 - DNA, 15 bp, Homo sapiens
accttttctaggaat

SEQ ID NO: 481722 - DNA, 15 bp, Homo sapiens
ccttttctaggaatt

SEQ ID NO: 481723 - DNA, 15 bp, Homo sapiens
cttttctaggaattc

SEQ ID NO: 481724 - DNA, 15 bp, Homo sapiens
ttttctaggaattca

SEQ ID NO: 481725 - DNA, 15 bp, Homo sapiens
tttctaggaattcac

SEQ ID NO: 481726 - DNA, 15 bp, Homo sapiens
ttctaggaattcacc

SEQ ID NO: 481727 - DNA, 15 bp, Homo sapiens
tctaggaattcacca

SEQ ID NO: 481728 - DNA, 15 bp, Homo sapiens
ctaggaattcaccaa

SEQ ID NO: 481729 - DNA, 15 bp, Homo sapiens
taggaattcaccaac

SEQ ID NO: 481730 - DNA, 15 bp, Homo sapiens
aggaattcaccaact

SEQ ID NO: 481731 - DNA, 15 bp, Homo sapiens
ggaattcaccaactg

SEQ ID NO: 481732 - DNA, 15 bp, Homo sapiens
gaattcaccaactgt

SEQ ID NO: 481733 - DNA, 15 bp, Homo sapiens
aattcaccaactgtc

SEQ ID NO: 481734 - DNA, 15 bp, Homo sapiens
attcaccaactgtct

SEQ ID NO: 481735 - DNA, 15 bp, Homo sapiens
ttcaccaactgtctg

SEQ ID NO: 481736 - DNA, 15 bp, Homo sapiens
tcaccaactgtctga

SEQ ID NO: 481737 - DNA, 15 bp, Homo sapiens
caccaactgtctgat

SEQ ID NO: 481738 - DNA, 15 bp, Homo sapiens
accaactgtctgata

SEQ ID NO: 481739 - DNA, 15 bp, Homo sapiens
ccaactgtctgatac

SEQ ID NO: 481740 - DNA, 15 bp, Homo sapiens
caactgtctgataca

SEQ ID NO: 481741 - DNA, 15 bp, Homo sapiens
aactgtctgatacaa

SEQ ID NO: 481742 - DNA, 15 bp, Homo sapiens
actgtctgatacaat

SEQ ID NO: 481743 - DNA, 15 bp, Homo sapiens
ctgtctgatacaatt

SEQ ID NO: 481744 - DNA, 15 bp, Homo sapiens
tgtctgatacaattt

SEQ ID NO: 481745 - DNA, 15 bp, Homo sapiens
gtctgatacaatttc

SEQ ID NO: 481746 - DNA, 15 bp, Homo sapiens
tctgatacaatttca

SEQ ID NO: 481747 - DNA, 15 bp, Homo sapiens
ctgatacaatttcaa

SEQ ID NO: 481748 - DNA, 15 bp, Homo sapiens
tgatacaatttcaag

SEQ ID NO: 481749 - DNA, 15 bp, Homo sapiens
gatacaatttcaagt

SEQ ID NO: 481750 - DNA, 15 bp, Homo sapiens
atacaatttcaagtc

SEQ ID NO: 481751 - DNA, 15 bp, Homo sapiens
tacaatttcaagtcc

SEQ ID NO: 481752 - DNA, 15 bp, Homo sapiens
acaatttcaagtccc

SEQ ID NO: 481753 - DNA, 15 bp, Homo sapiens
caatttcaagtccct

SEQ ID NO: 481754 - DNA, 15 bp, Homo sapiens
aatttcaagtccctt

SEQ ID NO: 481755 - DNA, 15 bp, Homo sapiens
atttcaagtcccttc

SEQ ID NO: 481756 - DNA, 15 bp, Homo sapiens
tttcaagtcccttcc

SEQ ID NO: 481757 - DNA, 15 bp, Homo sapiens
ttcaagtcccttcct

SEQ ID NO: 481758 - DNA, 15 bp, Homo sapiens
tcaagtcccttcctt

SEQ ID NO: 481759 - DNA, 15 bp, Homo sapiens
caagtcccttccttg

SEQ ID NO: 481760 - DNA, 15 bp, Homo sapiens
aagtcccttccttgt

SEQ ID NO: 481761 - DNA, 15 bp, Homo sapiens
agtcccttccttgtt

SEQ ID NO: 481762 - DNA, 15 bp, Homo sapiens
gtcccttccttgtta

SEQ ID NO: 481763 - DNA, 15 bp, Homo sapiens
tcccttccttgttag

SEQ ID NO: 481764 - DNA, 15 bp, Homo sapiens
cccttccttgttaga

SEQ ID NO: 481765 - DNA, 15 bp, Homo sapiens
ccttccttgttagag

SEQ ID NO: 481766 - DNA, 15 bp, Homo sapiens
cttccttgttagagt

SEQ ID NO: 481767 - DNA, 15 bp, Homo sapiens
ttccttgttagagta

SEQ ID NO: 481768 - DNA, 15 bp, Homo sapiens
tccttgttagagtaa

SEQ ID NO: 481769 - DNA, 15 bp, Homo sapiens
ccttgttagagtaaa

SEQ ID NO: 481770 - DNA, 15 bp, Homo sapiens
cttgttagagtaaac

SEQ ID NO: 481771 - DNA, 15 bp, Homo sapiens
ttgttagagtaaact

SEQ ID NO: 481772 - DNA, 15 bp, Homo sapiens
tgttagagtaaactg

SEQ ID NO: 481773 - DNA, 15 bp, Homo sapiens
gttagagtaaactgc

SEQ ID NO: 481774 - DNA, 15 bp, Homo sapiens
ttagagtaaactgca

SEQ ID NO: 481775 - DNA, 15 bp, Homo sapiens
tagagtaaactgcag

SEQ ID NO: 481776 - DNA, 15 bp, Homo sapiens
agagtaaactgcagt

SEQ ID NO: 481777 - DNA, 15 bp, Homo sapiens
gagtaaactgcagta

SEQ ID NO: 481778 - DNA, 15 bp, Homo sapiens
agtaaactgcagtaa

SEQ ID NO: 481779 - DNA, 15 bp, Homo sapiens
gtaaactgcagtaac

SEQ ID NO: 481780 - DNA, 15 bp, Homo sapiens
taaactgcagtaaca

SEQ ID NO: 481781 - DNA, 15 bp, Homo sapiens
aaactgcagtaacac

SEQ ID NO: 481782 - DNA, 15 bp, Homo sapiens
aactgcagtaacacc

SEQ ID NO: 481783 - DNA, 15 bp, Homo sapiens
actgcagtaacacca

SEQ ID NO: 481784 - DNA, 15 bp, Homo sapiens
ctgcagtaacaccaa

SEQ ID NO: 481785 - DNA, 15 bp, Homo sapiens
tgcagtaacaccaag

SEQ ID NO: 481786 - DNA, 15 bp, Homo sapiens
gcagtaacaccaaga

SEQ ID NO: 481787 - DNA, 15 bp, Homo sapiens
cagtaacaccaagat

SEQ ID NO: 481788 - DNA, 15 bp, Homo sapiens
agtaacaccaagatg

SEQ ID NO: 481789 - DNA, 15 bp, Homo sapiens
gtaacaccaagatga

SEQ ID NO: 481790 - DNA, 15 bp, Homo sapiens
taacaccaagatgaa

SEQ ID NO: 481791 - DNA, 15 bp, Homo sapiens
aacaccaagatgaat

SEQ ID NO: 481792 - DNA, 15 bp, Homo sapiens
acaccaagatgaatt

SEQ ID NO: 481793 - DNA, 15 bp, Homo sapiens
caccaagatgaattt

SEQ ID NO: 481794 - DNA, 15 bp, Homo sapiens
accaagatgaatttt

SEQ ID NO: 481795 - DNA, 15 bp, Homo sapiens
ccaagatgaattttc

SEQ ID NO: 481796 - DNA, 15 bp, Homo sapiens
caagatgaattttca

SEQ ID NO: 481797 - DNA, 15 bp, Homo sapiens
aagatgaattttcaa

SEQ ID NO: 481798 - DNA, 15 bp, Homo sapiens
agatgaattttcaaa

SEQ ID NO: 481799 - DNA, 15 bp, Homo sapiens
gatgaattttcaaac

SEQ ID NO: 481800 - DNA, 15 bp, Homo sapiens
atgaattttcaaacc

SEQ ID NO: 481801 - DNA, 15 bp, Homo sapiens
tgaattttcaaacca

SEQ ID NO: 481802 - DNA, 15 bp, Homo sapiens
gaattttcaaaccag

SEQ ID NO: 481803 - DNA, 15 bp, Homo sapiens
aattttcaaaccaga

SEQ ID NO: 481804 - DNA, 15 bp, Homo sapiens
attttcaaaccagaa

SEQ ID NO: 481805 - DNA, 15 bp, Homo sapiens
ttttcaaaccagaat

SEQ ID NO: 481806 - DNA, 15 bp, Homo sapiens
tttcaaaccagaatt

SEQ ID NO: 481807 - DNA, 15 bp, Homo sapiens
ttcaaaccagaatta

SEQ ID NO: 481808 - DNA, 15 bp, Homo sapiens
tcaaaccagaattac

SEQ ID NO: 481809 - DNA, 15 bp, Homo sapiens
caaaccagaattaca

SEQ ID NO: 481810 - DNA, 15 bp, Homo sapiens
aaaccagaattacaa

SEQ ID NO: 481811 - DNA, 15 bp, Homo sapiens
aaccagaattacaag

SEQ ID NO: 481812 - DNA, 15 bp, Homo sapiens
accagaattacaagt

SEQ ID NO: 481813 - DNA, 15 bp, Homo sapiens
ccagaattacaagta

SEQ ID NO: 481814 - DNA, 15 bp, Homo sapiens
cagaattacaagtac

SEQ ID NO: 481815 - DNA, 15 bp, Homo sapiens
agaattacaagtacc

SEQ ID NO: 481816 - DNA, 15 bp, Homo sapiens
gaattacaagtacca

SEQ ID NO: 481817 - DNA, 15 bp, Homo sapiens
aattacaagtaccag

SEQ ID NO: 481818 - DNA, 15 bp, Homo sapiens
attacaagtaccaga

SEQ ID NO: 481819 - DNA, 15 bp, Homo sapiens
ttacaagtaccagag

SEQ ID NO: 481820 - DNA, 15 bp, Homo sapiens
tacaagtaccagagg

SEQ ID NO: 481821 - DNA, 15 bp, Homo sapiens
acaagtaccagaggt

SEQ ID NO: 481822 - DNA, 15 bp, Homo sapiens
caagtaccagaggtc

SEQ ID NO: 481823 - DNA, 15 bp, Homo sapiens
aagtaccagaggtct

SEQ ID NO: 481824 - DNA, 15 bp, Homo sapiens
agtaccagaggtctt

SEQ ID NO: 481825 - DNA, 15 bp, Homo sapiens
gtaccagaggtcttc

SEQ ID NO: 481826 - DNA, 15 bp, Homo sapiens
taccagaggtcttcc

SEQ ID NO: 481827 - DNA, 15 bp, Homo sapiens
accagaggtcttccc

SEQ ID NO: 481828 - DNA, 15 bp, Homo sapiens
ccagaggtcttcccc

SEQ ID NO: 481829 - DNA, 15 bp, Homo sapiens
cagaggtcttcccca

SEQ ID NO: 481830 - DNA, 15 bp, Homo sapiens
agaggtcttccccag

SEQ ID NO: 481831 - DNA, 15 bp, Homo sapiens
gaggtcttccccagc

SEQ ID NO: 481832 - DNA, 15 bp, Homo sapiens
aggtcttccccagca

SEQ ID NO: 481833 - DNA, 15 bp, Homo sapiens
ggtcttccccagcat

SEQ ID NO: 481834 - DNA, 15 bp, Homo sapiens
gtcttccccagcatc

SEQ ID NO: 481835 - DNA, 15 bp, Homo sapiens
tcttccccagcatca

SEQ ID NO: 481836 - DNA, 15 bp, Homo sapiens
cttccccagcatcaa

SEQ ID NO: 481837 - DNA, 15 bp, Homo sapiens
ttccccagcatcaag

SEQ ID NO: 481838 - DNA, 15 bp, Homo sapiens
tccccagcatcaagt

SEQ ID NO: 481839 - DNA, 15 bp, Homo sapiens
ccccagcatcaagtg

SEQ ID NO: 481840 - DNA, 15 bp, Homo sapiens
cccagcatcaagtgt

SEQ ID NO: 481841 - DNA, 15 bp, Homo sapiens
ccagcatcaagtgtt

SEQ ID NO: 481842 - DNA, 15 bp, Homo sapiens
cagcatcaagtgtta

SEQ ID NO: 481843 - DNA, 15 bp, Homo sapiens
agcatcaagtgttac

SEQ ID NO: 481844 - DNA, 15 bp, Homo sapiens
gcatcaagtgttact

SEQ ID NO: 481845 - DNA, 15 bp, Homo sapiens
catcaagtgttactc

SEQ ID NO: 481846 - DNA, 15 bp, Homo sapiens
atcaagtgttactca

SEQ ID NO: 481847 - DNA, 15 bp, Homo sapiens
tcaagtgttactcat

SEQ ID NO: 481848 - DNA, 15 bp, Homo sapiens
caagtgttactcatc

SEQ ID NO: 481849 - DNA, 15 bp, Homo sapiens
aagtgttactcatca

SEQ ID NO: 481850 - DNA, 15 bp, Homo sapiens
agtgttactcatcag

SEQ ID NO: 481851 - DNA, 15 bp, Homo sapiens
gtgttactcatcagc

SEQ ID NO: 481852 - DNA, 15 bp, Homo sapiens
tgttactcatcagct

SEQ ID NO: 481853 - DNA, 15 bp, Homo sapiens
gttactcatcagctc

SEQ ID NO: 481854 - DNA, 15 bp, Homo sapiens
ttactcatcagctca

SEQ ID NO: 481855 - DNA, 15 bp, Homo sapiens
tactcatcagctcaa

SEQ ID NO: 481856 - DNA, 15 bp, Homo sapiens
actcatcagctcaag

SEQ ID NO: 481857 - DNA, 15 bp, Homo sapiens
ctcatcagctcaagg

SEQ ID NO: 481858 - DNA, 15 bp, Homo sapiens
tcatcagctcaaggg

SEQ ID NO: 481859 - DNA, 15 bp, Homo sapiens
catcagctcaagggc

SEQ ID NO: 481860 - DNA, 15 bp, Homo sapiens
atcagctcaagggca

SEQ ID NO: 481861 - DNA, 15 bp, Homo sapiens
tcagctcaagggcac

SEQ ID NO: 481862 - DNA, 15 bp, Homo sapiens
cagctcaagggcaca

SEQ ID NO: 481863 - DNA, 15 bp, Homo sapiens
agctcaagggcacag

SEQ ID NO: 481864 - DNA, 15 bp, Homo sapiens
gctcaagggcacagg

SEQ ID NO: 481865 - DNA, 15 bp, Homo sapiens
ctcaagggcacaggt

SEQ ID NO: 481866 - DNA, 15 bp, Homo sapiens
tcaagggcacaggta

SEQ ID NO: 481867 - DNA, 15 bp, Homo sapiens
caagggcacaggtaa

SEQ ID NO: 481868 - DNA, 15 bp, Homo sapiens
aagggcacaggtaat

SEQ ID NO: 481869 - DNA, 15 bp, Homo sapiens
agggcacaggtaatc

SEQ ID NO: 481870 - DNA, 15 bp, Homo sapiens
gggcacaggtaatct

SEQ ID NO: 481871 - DNA, 15 bp, Homo sapiens
ggcacaggtaatctc

SEQ ID NO: 481872 - DNA, 15 bp, Homo sapiens
gcacaggtaatctca

SEQ ID NO: 481873 - DNA, 15 bp, Homo sapiens
cacaggtaatctcaa

SEQ ID NO: 481874 - DNA, 15 bp, Homo sapiens
acaggtaatctcaag

SEQ ID NO: 481875 - DNA, 15 bp, Homo sapiens
caggtaatctcaagg

SEQ ID NO: 481876 - DNA, 15 bp, Homo sapiens
aggtaatctcaaggc

SEQ ID NO: 481877 - DNA, 15 bp, Homo sapiens
ggtaatctcaaggct

SEQ ID NO: 481878 - DNA, 15 bp, Homo sapiens
gtaatctcaaggctc

SEQ ID NO: 481879 - DNA, 15 bp, Homo sapiens
taatctcaaggctct

SEQ ID NO: 481880 - DNA, 15 bp, Homo sapiens
aatctcaaggctctg

SEQ ID NO: 481881 - DNA, 15 bp, Homo sapiens
atctcaaggctctgg

SEQ ID NO: 481882 - DNA, 15 bp, Homo sapiens
tctcaaggctctggt

SEQ ID NO: 481883 - DNA, 15 bp, Homo sapiens
ctcaaggctctggtg

SEQ ID NO: 481884 - DNA, 15 bp, Homo sapiens
tcaaggctctggtga

SEQ ID NO: 481885 - DNA, 15 bp, Homo sapiens
caaggctctggtgaa

SEQ ID NO: 481886 - DNA, 15 bp, Homo sapiens
aaggctctggtgaag

SEQ ID NO: 481887 - DNA, 15 bp, Homo sapiens
aggctctggtgaagc

SEQ ID NO: 481888 - DNA, 15 bp, Homo sapiens
ggctctggtgaagct

SEQ ID NO: 481889 - DNA, 15 bp, Homo sapiens
gctctggtgaagctg

SEQ ID NO: 481890 - DNA, 15 bp, Homo sapiens
ctctggtgaagctga

SEQ ID NO: 481891 - DNA, 15 bp, Homo sapiens
tctggtgaagctgag

SEQ ID NO: 481892 - DNA, 15 bp, Homo sapiens
ctggtgaagctgaga

SEQ ID NO: 481893 - DNA, 15 bp, Homo sapiens
tggtgaagctgagag

SEQ ID NO: 481894 - DNA, 15 bp, Homo sapiens
ggtgaagctgagaga

SEQ ID NO: 481895 - DNA, 15 bp, Homo sapiens
gtgaagctgagagag

SEQ ID NO: 481896 - DNA, 15 bp, Homo sapiens
tgaagctgagagagg

SEQ ID NO: 481897 - DNA, 15 bp, Homo sapiens
gaagctgagagaggc

SEQ ID NO: 481898 - DNA, 15 bp, Homo sapiens
aagctgagagaggcc

SEQ ID NO: 481899 - DNA, 15 bp, Homo sapiens
agctgagagaggccc

SEQ ID NO: 481900 - DNA, 15 bp, Homo sapiens
gctgagagaggccca

SEQ ID NO: 481901 - DNA, 15 bp, Homo sapiens
ctgagagaggcccag

SEQ ID NO: 481902 - DNA, 15 bp, Homo sapiens
tgagagaggcccagg

SEQ ID NO: 481903 - DNA, 15 bp, Homo sapiens
gagagaggcccagga

SEQ ID NO: 481904 - DNA, 15 bp, Homo sapiens
agagaggcccaggac

SEQ ID NO: 481905 - DNA, 15 bp, Homo sapiens
gagaggcccaggact

SEQ ID NO: 481906 - DNA, 15 bp, Homo sapiens
agaggcccaggactg

SEQ ID NO: 481907 - DNA, 15 bp, Homo sapiens
gaggcccaggactgc

SEQ ID NO: 481908 - DNA, 15 bp, Homo sapiens
aggcccaggactgcc

SEQ ID NO: 481909 - DNA, 15 bp, Homo sapiens
ggcccaggactgcca

SEQ ID NO: 481910 - DNA, 15 bp, Homo sapiens
gcccaggactgccag

SEQ ID NO: 481911 - DNA, 15 bp, Homo sapiens
cccaggactgccagc

SEQ ID NO: 481912 - DNA, 15 bp, Homo sapiens
ccaggactgccagca

SEQ ID NO: 481913 - DNA, 15 bp, Homo sapiens
caggactgccagcac

SEQ ID NO: 481914 - DNA, 15 bp, Homo sapiens
aggactgccagcacc

SEQ ID NO: 481915 - DNA, 15 bp, Homo sapiens
ggactgccagcacca

SEQ ID NO: 481916 - DNA, 15 bp, Homo sapiens
gactgccagcaccac

SEQ ID NO: 481917 - DNA, 15 bp, Homo sapiens
actgccagcaccaca

SEQ ID NO: 481918 - DNA, 15 bp, Homo sapiens
ctgccagcaccacac

SEQ ID NO: 481919 - DNA, 15 bp, Homo sapiens
tgccagcaccacaca

SEQ ID NO: 481920 - DNA, 15 bp, Homo sapiens
gccagcaccacacac

SEQ ID NO: 481921 - DNA, 15 bp, Homo sapiens
ccagcaccacacacc

SEQ ID NO: 481922 - DNA, 15 bp, Homo sapiens
cagcaccacacacca

SEQ ID NO: 481923 - DNA, 15 bp, Homo sapiens
agcaccacacaccag

SEQ ID NO: 481924 - DNA, 15 bp, Homo sapiens
gcaccacacaccagg

SEQ ID NO: 481925 - DNA, 15 bp, Homo sapiens
caccacacaccaggt

SEQ ID NO: 481926 - DNA, 15 bp, Homo sapiens
accacacaccaggtt

SEQ ID NO: 481927 - DNA, 15 bp, Homo sapiens
ccacacaccaggttc

SEQ ID NO: 481928 - DNA, 15 bp, Homo sapiens
cacacaccaggttct

SEQ ID NO: 481929 - DNA, 15 bp, Homo sapiens
acacaccaggttctt

SEQ ID NO: 481930 - DNA, 15 bp, Homo sapiens
cacaccaggttcttt

SEQ ID NO: 481931 - DNA, 15 bp, Homo sapiens
acaccaggttctttc

SEQ ID NO: 481932 - DNA, 15 bp, Homo sapiens
caccaggttctttct

SEQ ID NO: 481933 - DNA, 15 bp, Homo sapiens
accaggttctttctg

SEQ ID NO: 481934 - DNA, 15 bp, Homo sapiens
ccaggttctttctgg

SEQ ID NO: 481935 - DNA, 15 bp, Homo sapiens
caggttctttctggc

SEQ ID NO: 481936 - DNA, 15 bp, Homo sapiens
aggttctttctggct

SEQ ID NO: 481937 - DNA, 15 bp, Homo sapiens
ggttctttctggctg

SEQ ID NO: 481938 - DNA, 15 bp, Homo sapiens
gttctttctggctgc

SEQ ID NO: 481939 - DNA, 15 bp, Homo sapiens
ttctttctggctgca

SEQ ID NO: 481940 - DNA, 15 bp, Homo sapiens
tctttctggctgcaa

SEQ ID NO: 481941 - DNA, 15 bp, Homo sapiens
ctttctggctgcaac

SEQ ID NO: 481942 - DNA, 15 bp, Homo sapiens
tttctggctgcaaca

SEQ ID NO: 481943 - DNA, 15 bp, Homo sapiens
ttctggctgcaacag

SEQ ID NO: 481944 - DNA, 15 bp, Homo sapiens
tctggctgcaacagg

SEQ ID NO: 481945 - DNA, 15 bp, Homo sapiens
ctggctgcaacagga

SEQ ID NO: 481946 - DNA, 15 bp, Homo sapiens
tggctgcaacaggat

SEQ ID NO: 481947 - DNA, 15 bp, Homo sapiens
ggctgcaacaggatg

SEQ ID NO: 481948 - DNA, 15 bp, Homo sapiens
gctgcaacaggatgc

SEQ ID NO: 481949 - DNA, 15 bp, Homo sapiens
ctgcaacaggatgct

SEQ ID NO: 481950 - DNA, 15 bp, Homo sapiens
tgcaacaggatgctg

SEQ ID NO: 481951 - DNA, 15 bp, Homo sapiens
gcaacaggatgctgt

SEQ ID NO: 481952 - DNA, 15 bp, Homo sapiens
caacaggatgctgtc

SEQ ID NO: 481953 - DNA, 15 bp, Homo sapiens
aacaggatgctgtct

SEQ ID NO: 481954 - DNA, 15 bp, Homo sapiens
acaggatgctgtctg

SEQ ID NO: 481955 - DNA, 15 bp, Homo sapiens
caggatgctgtctga

SEQ ID NO: 481956 - DNA, 15 bp, Homo sapiens
aggatgctgtctgac

SEQ ID NO: 481957 - DNA, 15 bp, Homo sapiens
ggatgctgtctgact

SEQ ID NO: 481958 - DNA, 15 bp, Homo sapiens
gatgctgtctgactc

SEQ ID NO: 481959 - DNA, 15 bp, Homo sapiens
atgctgtctgactcc

SEQ ID NO: 481960 - DNA, 15 bp, Homo sapiens
tgctgtctgactcca

SEQ ID NO: 481961 - DNA, 15 bp, Homo sapiens
gctgtctgactccag

SEQ ID NO: 481962 - DNA, 15 bp, Homo sapiens
ctgtctgactccaga

SEQ ID NO: 481963 - DNA, 15 bp, Homo sapiens
tgtctgactccagag

SEQ ID NO: 481964 - DNA, 15 bp, Homo sapiens
gtctgactccagagt

SEQ ID NO: 481965 - DNA, 15 bp, Homo sapiens
tctgactccagagta

SEQ ID NO: 481966 - DNA, 15 bp, Homo sapiens
ctgactccagagtaa

SEQ ID NO: 481967 - DNA, 15 bp, Homo sapiens
tgactccagagtaac

SEQ ID NO: 481968 - DNA, 15 bp, Homo sapiens
gactccagagtaaca

SEQ ID NO: 481969 - DNA, 15 bp, Homo sapiens
actccagagtaacag

SEQ ID NO: 481970 - DNA, 15 bp, Homo sapiens
ctccagagtaacaga

SEQ ID NO: 481971 - DNA, 15 bp, Homo sapiens
tccagagtaacagaa

SEQ ID NO: 481972 - DNA, 15 bp, Homo sapiens
ccagagtaacagaag

SEQ ID NO: 481973 - DNA, 15 bp, Homo sapiens
cagagtaacagaaga

SEQ ID NO: 481974 - DNA, 15 bp, Homo sapiens
agagtaacagaagaa

SEQ ID NO: 481975 - DNA, 15 bp, Homo sapiens
gagtaacagaagaag

SEQ ID NO: 481976 - DNA, 15 bp, Homo sapiens
agtaacagaagaagt

SEQ ID NO: 481977 - DNA, 15 bp, Homo sapiens
gtaacagaagaagtc

SEQ ID NO: 481978 - DNA, 15 bp, Homo sapiens
taacagaagaagtct

SEQ ID NO: 481979 - DNA, 15 bp, Homo sapiens
aacagaagaagtctc

SEQ ID NO: 481980 - DNA, 15 bp, Homo sapiens
acagaagaagtctct

SEQ ID NO: 481981 - DNA, 15 bp, Homo sapiens
cagaagaagtctcta

SEQ ID NO: 481982 - DNA, 15 bp, Homo sapiens
agaagaagtctctaa

SEQ ID NO: 481983 - DNA, 15 bp, Homo sapiens
gaagaagtctctaag

SEQ ID NO: 481984 - DNA, 15 bp, Homo sapiens
aagaagtctctaagg

SEQ ID NO: 481985 - DNA, 15 bp, Homo sapiens
agaagtctctaaggg

SEQ ID NO: 481986 - DNA, 15 bp, Homo sapiens
gaagtctctaaggga

SEQ ID NO: 481987 - DNA, 15 bp, Homo sapiens
aagtctctaagggat

SEQ ID NO: 481988 - DNA, 15 bp, Homo sapiens
agtctctaagggatg

SEQ ID NO: 481989 - DNA, 15 bp, Homo sapiens
gtctctaagggatgt

SEQ ID NO: 481990 - DNA, 15 bp, Homo sapiens
tctctaagggatgtt

SEQ ID NO: 481991 - DNA, 15 bp, Homo sapiens
ctctaagggatgttc

SEQ ID NO: 481992 - DNA, 15 bp, Homo sapiens
tctaagggatgttcg

SEQ ID NO: 481993 - DNA, 15 bp, Homo sapiens
ctaagggatgttcgc

SEQ ID NO: 481994 - DNA, 15 bp, Homo sapiens
taagggatgttcgca

SEQ ID NO: 481995 - DNA, 15 bp, Homo sapiens
aagggatgttcgcag

SEQ ID NO: 481996 - DNA, 15 bp, Homo sapiens
agggatgttcgcagc

SEQ ID NO: 481997 - DNA, 15 bp, Homo sapiens
gggatgttcgcagcc

SEQ ID NO: 481998 - DNA, 15 bp, Homo sapiens
ggatgttcgcagccc

SEQ ID NO: 481999 - DNA, 15 bp, Homo sapiens
gatgttcgcagcccc

SEQ ID NO: 482000 - DNA, 15 bp, Homo sapiens
atgttcgcagccccc

SEQ ID NO: 482001 - DNA, 15 bp, Homo sapiens
tgttcgcagccccca

SEQ ID NO: 482002 - DNA, 15 bp, Homo sapiens
gttcgcagcccccat

SEQ ID NO: 482003 - DNA, 15 bp, Homo sapiens
ttcgcagcccccatc

SEQ ID NO: 482004 - DNA, 15 bp, Homo sapiens
tcgcagcccccatcg

SEQ ID NO: 482005 - DNA, 15 bp, Homo sapiens
cgcagcccccatcgc

SEQ ID NO: 482006 - DNA, 15 bp, Homo sapiens
gcagcccccatcgct

SEQ ID NO: 482007 - DNA, 15 bp, Homo sapiens
cagcccccatcgctt

SEQ ID NO: 482008 - DNA, 15 bp, Homo sapiens
agcccccatcgctta

SEQ ID NO: 482009 - DNA, 15 bp, Homo sapiens
gcccccatcgcttac

SEQ ID NO: 482010 - DNA, 15 bp, Homo sapiens
cccccatcgcttaca

SEQ ID NO: 482011 - DNA, 15 bp, Homo sapiens
ccccatcgcttacac

SEQ ID NO: 482012 - DNA, 15 bp, Homo sapiens
cccatcgcttacaca

SEQ ID NO: 482013 - DNA, 15 bp, Homo sapiens
ccatcgcttacacag

SEQ ID NO: 482014 - DNA, 15 bp, Homo sapiens
catcgcttacacagg

SEQ ID NO: 482015 - DNA, 15 bp, Homo sapiens
atcgcttacacagga

SEQ ID NO: 482016 - DNA, 15 bp, Homo sapiens
tcgcttacacaggaa

SEQ ID NO: 482017 - DNA, 15 bp, Homo sapiens
cgcttacacaggaag

SEQ ID NO: 482018 - DNA, 15 bp, Homo sapiens
gcttacacaggaagg

SEQ ID NO: 482019 - DNA, 15 bp, Homo sapiens
cttacacaggaagga

SEQ ID NO: 482020 - DNA, 15 bp, Homo sapiens
ttacacaggaaggag

SEQ ID NO: 482021 - DNA, 15 bp, Homo sapiens
tacacaggaaggagc

SEQ ID NO: 482022 - DNA, 15 bp, Homo sapiens
acacaggaaggagct

SEQ ID NO: 482023 - DNA, 15 bp, Homo sapiens
cacaggaaggagctg

SEQ ID NO: 482024 - DNA, 15 bp, Homo sapiens
acaggaaggagctgc

SEQ ID NO: 482025 - DNA, 15 bp, Homo sapiens
caggaaggagctgct

SEQ ID NO: 482026 - DNA, 15 bp, Homo sapiens
aggaaggagctgctt

SEQ ID NO: 482027 - DNA, 15 bp, Homo sapiens
ggaaggagctgcttc

SEQ ID NO: 482028 - DNA, 15 bp, Homo sapiens
gaaggagctgcttca

SEQ ID NO: 482029 - DNA, 15 bp, Homo sapiens
aaggagctgcttcag

SEQ ID NO: 482030 - DNA, 15 bp, Homo sapiens
aggagctgcttcagt

SEQ ID NO: 482031 - DNA, 15 bp, Homo sapiens
ggagctgcttcagtc

SEQ ID NO: 482032 - DNA, 15 bp, Homo sapiens
gagctgcttcagtca

SEQ ID NO: 482033 - DNA, 15 bp, Homo sapiens
agctgcttcagtcat

SEQ ID NO: 482034 - DNA, 15 bp, Homo sapiens
gctgcttcagtcatg

SEQ ID NO: 482035 - DNA, 15 bp, Homo sapiens
ctgcttcagtcatga

SEQ ID NO: 482036 - DNA, 15 bp, Homo sapiens
tgcttcagtcatgag

SEQ ID NO: 482037 - DNA, 15 bp, Homo sapiens
gcttcagtcatgaga

SEQ ID NO: 482038 - DNA, 15 bp, Homo sapiens
cttcagtcatgagat

SEQ ID NO: 482039 - DNA, 15 bp, Homo sapiens
ttcagtcatgagata

SEQ ID NO: 482040 - DNA, 15 bp, Homo sapiens
tcagtcatgagatag

SEQ ID NO: 482041 - DNA, 15 bp, Homo sapiens
cagtcatgagatagc

SEQ ID NO: 482042 - DNA, 15 bp, Homo sapiens
agtcatgagatagcc

SEQ ID NO: 482043 - DNA, 15 bp, Homo sapiens
gtcatgagatagccc

SEQ ID NO: 482044 - DNA, 15 bp, Homo sapiens
tcatgagatagcccc

SEQ ID NO: 482045 - DNA, 15 bp, Homo sapiens
catgagatagcccca

SEQ ID NO: 482046 - DNA, 15 bp, Homo sapiens
atgagatagccccat

SEQ ID NO: 482047 - DNA, 15 bp, Homo sapiens
tgagatagccccatt

SEQ ID NO: 482048 - DNA, 15 bp, Homo sapiens
gagatagccccattt

SEQ ID NO: 482049 - DNA, 15 bp, Homo sapiens
agatagccccatttg

SEQ ID NO: 482050 - DNA, 15 bp, Homo sapiens
gatagccccatttga

SEQ ID NO: 482051 - DNA, 15 bp, Homo sapiens
atagccccatttgac

SEQ ID NO: 482052 - DNA, 15 bp, Homo sapiens
tagccccatttgaca

SEQ ID NO: 482053 - DNA, 15 bp, Homo sapiens
agccccatttgacac

SEQ ID NO: 482054 - DNA, 15 bp, Homo sapiens
gccccatttgacact

SEQ ID NO: 482055 - DNA, 15 bp, Homo sapiens
ccccatttgacactc

SEQ ID NO: 482056 - DNA, 15 bp, Homo sapiens
cccatttgacactct

SEQ ID NO: 482057 - DNA, 15 bp, Homo sapiens
ccatttgacactctg

SEQ ID NO: 482058 - DNA, 15 bp, Homo sapiens
catttgacactctga

SEQ ID NO: 482059 - DNA, 15 bp, Homo sapiens
atttgacactctgat

SEQ ID NO: 482060 - DNA, 15 bp, Homo sapiens
tttgacactctgata

SEQ ID NO: 482061 - DNA, 15 bp, Homo sapiens
ttgacactctgatag

SEQ ID NO: 482062 - DNA, 15 bp, Homo sapiens
tgacactctgatagc

SEQ ID NO: 482063 - DNA, 15 bp, Homo sapiens
gacactctgatagct

SEQ ID NO: 482064 - DNA, 15 bp, Homo sapiens
acactctgatagcta

SEQ ID NO: 482065 - DNA, 15 bp, Homo sapiens
cactctgatagctac

SEQ ID NO: 482066 - DNA, 15 bp, Homo sapiens
actctgatagctaca

SEQ ID NO: 482067 - DNA, 15 bp, Homo sapiens
ctctgatagctacat

SEQ ID NO: 482068 - DNA, 15 bp, Homo sapiens
tctgatagctacata

SEQ ID NO: 482069 - DNA, 15 bp, Homo sapiens
ctgatagctacataa

SEQ ID NO: 482070 - DNA, 15 bp, Homo sapiens
tgatagctacataac

SEQ ID NO: 482071 - DNA, 15 bp, Homo sapiens
gatagctacataact

SEQ ID NO: 482072 - DNA, 15 bp, Homo sapiens
atagctacataactg

SEQ ID NO: 482073 - DNA, 15 bp, Homo sapiens
tagctacataactga

SEQ ID NO: 482074 - DNA, 15 bp, Homo sapiens
agctacataactgac

SEQ ID NO: 482075 - DNA, 15 bp, Homo sapiens
gctacataactgaca

SEQ ID NO: 482076 - DNA, 15 bp, Homo sapiens
ctacataactgacat

SEQ ID NO: 482077 - DNA, 15 bp, Homo sapiens
tacataactgacatg

SEQ ID NO: 482078 - DNA, 15 bp, Homo sapiens
acataactgacatga

SEQ ID NO: 482079 - DNA, 15 bp, Homo sapiens
cataactgacatgag

SEQ ID NO: 482080 - DNA, 15 bp, Homo sapiens
ataactgacatgagg

SEQ ID NO: 482081 - DNA, 15 bp, Homo sapiens
taactgacatgaggt

SEQ ID NO: 482082 - DNA, 15 bp, Homo sapiens
aactgacatgaggtt

SEQ ID NO: 482083 - DNA, 15 bp, Homo sapiens
actgacatgaggttt

SEQ ID NO: 482084 - DNA, 15 bp, Homo sapiens
ctgacatgaggtttt

SEQ ID NO: 482085 - DNA, 15 bp, Homo sapiens
tgacatgaggttttc

SEQ ID NO: 482086 - DNA, 15 bp, Homo sapiens
gacatgaggttttcc

SEQ ID NO: 482087 - DNA, 15 bp, Homo sapiens
acatgaggttttcct

SEQ ID NO: 482088 - DNA, 15 bp, Homo sapiens
catgaggttttcctg

SEQ ID NO: 482089 - DNA, 15 bp, Homo sapiens
atgaggttttcctgc

SEQ ID NO: 482090 - DNA, 15 bp, Homo sapiens
tgaggttttcctgct

SEQ ID NO: 482091 - DNA, 15 bp, Homo sapiens
gaggttttcctgctg

SEQ ID NO: 482092 - DNA, 15 bp, Homo sapiens
aggttttcctgctgc

SEQ ID NO: 482093 - DNA, 15 bp, Homo sapiens
ggttttcctgctgcc

SEQ ID NO: 482094 - DNA, 15 bp, Homo sapiens
gttttcctgctgccc

SEQ ID NO: 482095 - DNA, 15 bp, Homo sapiens
ttttcctgctgccct

SEQ ID NO: 482096 - DNA, 15 bp, Homo sapiens
tttcctgctgcccta

SEQ ID NO: 482097 - DNA, 15 bp, Homo sapiens
ttcctgctgccctat

SEQ ID NO: 482098 - DNA, 15 bp, Homo sapiens
tcctgctgccctatc

SEQ ID NO: 482099 - DNA, 15 bp, Homo sapiens
cctgctgccctatcc

SEQ ID NO: 482100 - DNA, 15 bp, Homo sapiens
ctgctgccctatcct

SEQ ID NO: 482101 - DNA, 15 bp, Homo sapiens
tgctgccctatcctg

SEQ ID NO: 482102 - DNA, 15 bp, Homo sapiens
gctgccctatcctgt

SEQ ID NO: 482103 - DNA, 15 bp, Homo sapiens
ctgccctatcctgta

SEQ ID NO: 482104 - DNA, 15 bp, Homo sapiens
tgccctatcctgtaa

SEQ ID NO: 482105 - DNA, 15 bp, Homo sapiens
gccctatcctgtaaa

SEQ ID NO: 482106 - DNA, 15 bp, Homo sapiens
ccctatcctgtaaag

SEQ ID NO: 482107 - DNA, 15 bp, Homo sapiens
cctatcctgtaaagc

SEQ ID NO: 482108 - DNA, 15 bp, Homo sapiens
ctatcctgtaaagcc

SEQ ID NO: 482109 - DNA, 15 bp, Homo sapiens
tatcctgtaaagcca

SEQ ID NO: 482110 - DNA, 15 bp, Homo sapiens
atcctgtaaagccat

SEQ ID NO: 482111 - DNA, 15 bp, Homo sapiens
tcctgtaaagccatc

SEQ ID NO: 482112 - DNA, 15 bp, Homo sapiens
cctgtaaagccatcg

SEQ ID NO: 482113 - DNA, 15 bp, Homo sapiens
ctgtaaagccatcga

SEQ ID NO: 482114 - DNA, 15 bp, Homo sapiens
tgtaaagccatcgat

SEQ ID NO: 482115 - DNA, 15 bp, Homo sapiens
gtaaagccatcgatt

SEQ ID NO: 482116 - DNA, 15 bp, Homo sapiens
taaagccatcgattt

SEQ ID NO: 482117 - DNA, 15 bp, Homo sapiens
aaagccatcgatttc

SEQ ID NO: 482118 - DNA, 15 bp, Homo sapiens
aagccatcgatttcc

SEQ ID NO: 482119 - DNA, 15 bp, Homo sapiens
agccatcgatttcca

SEQ ID NO: 482120 - DNA, 15 bp, Homo sapiens
gccatcgatttccag

SEQ ID NO: 482121 - DNA, 15 bp, Homo sapiens
ccatcgatttccagg

SEQ ID NO: 482122 - DNA, 15 bp, Homo sapiens
catcgatttccagga

SEQ ID NO: 482123 - DNA, 15 bp, Homo sapiens
atcgatttccaggac

SEQ ID NO: 482124 - DNA, 15 bp, Homo sapiens
tcgatttccaggact

SEQ ID NO: 482125 - DNA, 15 bp, Homo sapiens
cgatttccaggactt

SEQ ID NO: 482126 - DNA, 15 bp, Homo sapiens
gatttccaggacttg

SEQ ID NO: 482127 - DNA, 15 bp, Homo sapiens
atttccaggacttgt

SEQ ID NO: 482128 - DNA, 15 bp, Homo sapiens
tttccaggacttgtt

SEQ ID NO: 482129 - DNA, 15 bp, Homo sapiens
ttccaggacttgttt

SEQ ID NO: 482130 - DNA, 15 bp, Homo sapiens
tccaggacttgttta

SEQ ID NO: 482131 - DNA, 15 bp, Homo sapiens
ccaggacttgtttac

SEQ ID NO: 482132 - DNA, 15 bp, Homo sapiens
caggacttgtttacc

SEQ ID NO: 482133 - DNA, 15 bp, Homo sapiens
aggacttgtttacca

SEQ ID NO: 482134 - DNA, 15 bp, Homo sapiens
ggacttgtttaccaa

SEQ ID NO: 482135 - DNA, 15 bp, Homo sapiens
gacttgtttaccaaa

SEQ ID NO: 482136 - DNA, 15 bp, Homo sapiens
acttgtttaccaaaa

SEQ ID NO: 482137 - DNA, 15 bp, Homo sapiens
cttgtttaccaaaag

SEQ ID NO: 482138 - DNA, 15 bp, Homo sapiens
ttgtttaccaaaagc

SEQ ID NO: 482139 - DNA, 15 bp, Homo sapiens
tgtttaccaaaagcc

SEQ ID NO: 482140 - DNA, 15 bp, Homo sapiens
gtttaccaaaagcca

SEQ ID NO: 482141 - DNA, 15 bp, Homo sapiens
tttaccaaaagccat

SEQ ID NO: 482142 - DNA, 15 bp, Homo sapiens
ttaccaaaagccatc

SEQ ID NO: 482143 - DNA, 15 bp, Homo sapiens
taccaaaagccatca

SEQ ID NO: 482144 - DNA, 15 bp, Homo sapiens
accaaaagccatcaa

SEQ ID NO: 482145 - DNA, 15 bp, Homo sapiens
ccaaaagccatcaaa

SEQ ID NO: 482146 - DNA, 15 bp, Homo sapiens
caaaagccatcaaaa

SEQ ID NO: 482147 - DNA, 15 bp, Homo sapiens
aaaagccatcaaaac

SEQ ID NO: 482148 - DNA, 15 bp, Homo sapiens
aaagccatcaaaacg

SEQ ID NO: 482149 - DNA, 15 bp, Homo sapiens
aagccatcaaaacgg

SEQ ID NO: 482150 - DNA, 15 bp, Homo sapiens
agccatcaaaacgga

SEQ ID NO: 482151 - DNA, 15 bp, Homo sapiens
gccatcaaaacggac

SEQ ID NO: 482152 - DNA, 15 bp, Homo sapiens
ccatcaaaacggacc

SEQ ID NO: 482153 - DNA, 15 bp, Homo sapiens
catcaaaacggacca

SEQ ID NO: 482154 - DNA, 15 bp, Homo sapiens
atcaaaacggaccac

SEQ ID NO: 482155 - DNA, 15 bp, Homo sapiens
tcaaaacggaccacg

SEQ ID NO: 482156 - DNA, 15 bp, Homo sapiens
caaaacggaccacgt

SEQ ID NO: 482157 - DNA, 15 bp, Homo sapiens
aaaacggaccacgtg

SEQ ID NO: 482158 - DNA, 15 bp, Homo sapiens
aaacggaccacgtgc

SEQ ID NO: 482159 - DNA, 15 bp, Homo sapiens
aacggaccacgtgcc

SEQ ID NO: 482160 - DNA, 15 bp, Homo sapiens
acggaccacgtgcca

SEQ ID NO: 482161 - DNA, 15 bp, Homo sapiens
cggaccacgtgccat

SEQ ID NO: 482162 - DNA, 15 bp, Homo sapiens
ggaccacgtgccatc

SEQ ID NO: 482163 - DNA, 15 bp, Homo sapiens
gaccacgtgccatct

SEQ ID NO: 482164 - DNA, 15 bp, Homo sapiens
accacgtgccatctg

SEQ ID NO: 482165 - DNA, 15 bp, Homo sapiens
ccacgtgccatctgc

SEQ ID NO: 482166 - DNA, 15 bp, Homo sapiens
cacgtgccatctgct

SEQ ID NO: 482167 - DNA, 15 bp, Homo sapiens
acgtgccatctgcta

SEQ ID NO: 482168 - DNA, 15 bp, Homo sapiens
cgtgccatctgctaa

SEQ ID NO: 482169 - DNA, 15 bp, Homo sapiens
gtgccatctgctaat

SEQ ID NO: 482170 - DNA, 15 bp, Homo sapiens
tgccatctgctaatg

SEQ ID NO: 482171 - DNA, 15 bp, Homo sapiens
gccatctgctaatgg

SEQ ID NO: 482172 - DNA, 15 bp, Homo sapiens
ccatctgctaatgga

SEQ ID NO: 482173 - DNA, 15 bp, Homo sapiens
catctgctaatggac

SEQ ID NO: 482174 - DNA, 15 bp, Homo sapiens
atctgctaatggact

SEQ ID NO: 482175 - DNA, 15 bp, Homo sapiens
tctgctaatggactg

SEQ ID NO: 482176 - DNA, 15 bp, Homo sapiens
ctgctaatggactgc

SEQ ID NO: 482177 - DNA, 15 bp, Homo sapiens
tgctaatggactgcc

SEQ ID NO: 482178 - DNA, 15 bp, Homo sapiens
gctaatggactgccc

SEQ ID NO: 482179 - DNA, 15 bp, Homo sapiens
ctaatggactgccct

SEQ ID NO: 482180 - DNA, 15 bp, Homo sapiens
taatggactgccctg

SEQ ID NO: 482181 - DNA, 15 bp, Homo sapiens
aatggactgccctgc

SEQ ID NO: 482182 - DNA, 15 bp, Homo sapiens
atggactgccctgct

SEQ ID NO: 482183 - DNA, 15 bp, Homo sapiens
tggactgccctgcta

SEQ ID NO: 482184 - DNA, 15 bp, Homo sapiens
ggactgccctgctag

SEQ ID NO: 482185 - DNA, 15 bp, Homo sapiens
gactgccctgctagt

SEQ ID NO: 482186 - DNA, 15 bp, Homo sapiens
actgccctgctagta

SEQ ID NO: 482187 - DNA, 15 bp, Homo sapiens
ctgccctgctagtat

SEQ ID NO: 482188 - DNA, 15 bp, Homo sapiens
tgccctgctagtatt

SEQ ID NO: 482189 - DNA, 15 bp, Homo sapiens
gccctgctagtatta

SEQ ID NO: 482190 - DNA, 15 bp, Homo sapiens
ccctgctagtattag

SEQ ID NO: 482191 - DNA, 15 bp, Homo sapiens
cctgctagtattagc

SEQ ID NO: 482192 - DNA, 15 bp, Homo sapiens
ctgctagtattagcc

SEQ ID NO: 482193 - DNA, 15 bp, Homo sapiens
tgctagtattagcca

SEQ ID NO: 482194 - DNA, 15 bp, Homo sapiens
gctagtattagccag

SEQ ID NO: 482195 - DNA, 15 bp, Homo sapiens
ctagtattagccagg

SEQ ID NO: 482196 - DNA, 15 bp, Homo sapiens
tagtattagccagga

SEQ ID NO: 482197 - DNA, 15 bp, Homo sapiens
agtattagccaggag

SEQ ID NO: 482198 - DNA, 15 bp, Homo sapiens
gtattagccaggaga

SEQ ID NO: 482199 - DNA, 15 bp, Homo sapiens
tattagccaggagat

SEQ ID NO: 482200 - DNA, 15 bp, Homo sapiens
attagccaggagatt

SEQ ID NO: 482201 - DNA, 15 bp, Homo sapiens
ttagccaggagattg

SEQ ID NO: 482202 - DNA, 15 bp, Homo sapiens
tagccaggagattgg

SEQ ID NO: 482203 - DNA, 15 bp, Homo sapiens
agccaggagattggt

SEQ ID NO: 482204 - DNA, 15 bp, Homo sapiens
gccaggagattggta

SEQ ID NO: 482205 - DNA, 15 bp, Homo sapiens
ccaggagattggtat

SEQ ID NO: 482206 - DNA, 15 bp, Homo sapiens
caggagattggtatt

SEQ ID NO: 482207 - DNA, 15 bp, Homo sapiens
aggagattggtattt

SEQ ID NO: 482208 - DNA, 15 bp, Homo sapiens
ggagattggtatttg

SEQ ID NO: 482209 - DNA, 15 bp, Homo sapiens
gagattggtatttgc

SEQ ID NO: 482210 - DNA, 15 bp, Homo sapiens
agattggtatttgca

SEQ ID NO: 482211 - DNA, 15 bp, Homo sapiens
gattggtatttgcac

SEQ ID NO: 482212 - DNA, 15 bp, Homo sapiens
attggtatttgcaca

SEQ ID NO: 482213 - DNA, 15 bp, Homo sapiens
ttggtatttgcacat

SEQ ID NO: 482214 - DNA, 15 bp, Homo sapiens
tggtatttgcacatt

SEQ ID NO: 482215 - DNA, 15 bp, Homo sapiens
ggtatttgcacattt

SEQ ID NO: 482216 - DNA, 15 bp, Homo sapiens
gtatttgcacattta

SEQ ID NO: 482217 - DNA, 15 bp, Homo sapiens
tatttgcacatttat

SEQ ID NO: 482218 - DNA, 15 bp, Homo sapiens
atttgcacatttata

SEQ ID NO: 482219 - DNA, 15 bp, Homo sapiens
tttgcacatttataa

SEQ ID NO: 482220 - DNA, 15 bp, Homo sapiens
ttgcacatttataag

SEQ ID NO: 482221 - DNA, 15 bp, Homo sapiens
tgcacatttataaga

SEQ ID NO: 482222 - DNA, 15 bp, Homo sapiens
gcacatttataagat

SEQ ID NO: 482223 - DNA, 15 bp, Homo sapiens
cacatttataagatc

SEQ ID NO: 482224 - DNA, 15 bp, Homo sapiens
acatttataagatct

SEQ ID NO: 482225 - DNA, 15 bp, Homo sapiens
catttataagatctc

SEQ ID NO: 482226 - DNA, 15 bp, Homo sapiens
atttataagatctca

SEQ ID NO: 482227 - DNA, 15 bp, Homo sapiens
tttataagatctcac

SEQ ID NO: 482228 - DNA, 15 bp, Homo sapiens
ttataagatctcact

SEQ ID NO: 482229 - DNA, 15 bp, Homo sapiens
tataagatctcactg

SEQ ID NO: 482230 - DNA, 15 bp, Homo sapiens
ataagatctcactgg

SEQ ID NO: 482231 - DNA, 15 bp, Homo sapiens
taagatctcactgga

SEQ ID NO: 482232 - DNA, 15 bp, Homo sapiens
aagatctcactggat

SEQ ID NO: 482233 - DNA, 15 bp, Homo sapiens
agatctcactggatc

SEQ ID NO: 482234 - DNA, 15 bp, Homo sapiens
gatctcactggatct

SEQ ID NO: 482235 - DNA, 15 bp, Homo sapiens
atctcactggatctc

SEQ ID NO: 482236 - DNA, 15 bp, Homo sapiens
tctcactggatctct

SEQ ID NO: 482237 - DNA, 15 bp, Homo sapiens
ctcactggatctctc

SEQ ID NO: 482238 - DNA, 15 bp, Homo sapiens
tcactggatctctct

SEQ ID NO: 482239 - DNA, 15 bp, Homo sapiens
cactggatctctctt

SEQ ID NO: 482240 - DNA, 15 bp, Homo sapiens
actggatctctcttg

SEQ ID NO: 482241 - DNA, 15 bp, Homo sapiens
ctggatctctcttgt

SEQ ID NO: 482242 - DNA, 15 bp, Homo sapiens
tggatctctcttgtt

SEQ ID NO: 482243 - DNA, 15 bp, Homo sapiens
ggatctctcttgttg

SEQ ID NO: 482244 - DNA, 15 bp, Homo sapiens
gatctctcttgttga

SEQ ID NO: 482245 - DNA, 15 bp, Homo sapiens
atctctcttgttgaa

SEQ ID NO: 482246 - DNA, 15 bp, Homo sapiens
tctctcttgttgaaa

SEQ ID NO: 482247 - DNA, 15 bp, Homo sapiens
ctctcttgttgaaag

SEQ ID NO: 482248 - DNA, 15 bp, Homo sapiens
tctcttgttgaaaga

SEQ ID NO: 482249 - DNA, 15 bp, Homo sapiens
tcttgttgaaagaag

SEQ ID NO: 482250 - DNA, 15 bp, Homo sapiens
cttgttgaaagaaga

SEQ ID NO: 482251 - DNA, 15 bp, Homo sapiens
ttgttgaaagaagat

SEQ ID NO: 482252 - DNA, 15 bp, Homo sapiens
tgttgaaagaagata

SEQ ID NO: 482253 - DNA, 15 bp, Homo sapiens
gttgaaagaagataa

SEQ ID NO: 482254 - DNA, 15 bp, Homo sapiens
ttgaaagaagataag

SEQ ID NO: 482255 - DNA, 15 bp, Homo sapiens
tgaaagaagataaga

SEQ ID NO: 482256 - DNA, 15 bp, Homo sapiens
gaaagaagataagaa

SEQ ID NO: 482257 - DNA, 15 bp, Homo sapiens
aaagaagataagaaa

SEQ ID NO: 482258 - DNA, 15 bp, Homo sapiens
aagaagataagaaat

SEQ ID NO: 482259 - DNA, 15 bp, Homo sapiens
agaagataagaaatt

SEQ ID NO: 482260 - DNA, 15 bp, Homo sapiens
gaagataagaaattc

SEQ ID NO: 482261 - DNA, 15 bp, Homo sapiens
aagataagaaattcc

SEQ ID NO: 482262 - DNA, 15 bp, Homo sapiens
agataagaaattccg

SEQ ID NO: 482263 - DNA, 15 bp, Homo sapiens
gataagaaattccga

SEQ ID NO: 482264 - DNA, 15 bp, Homo sapiens
ataagaaattccgag

SEQ ID NO: 482265 - DNA, 15 bp, Homo sapiens
taagaaattccgagt

SEQ ID NO: 482266 - DNA, 15 bp, Homo sapiens
aagaaattccgagtc

SEQ ID NO: 482267 - DNA, 15 bp, Homo sapiens
agaaattccgagtct

SEQ ID NO: 482268 - DNA, 15 bp, Homo sapiens
gaaattccgagtctg

SEQ ID NO: 482269 - DNA, 15 bp, Homo sapiens
aaattccgagtctgc

SEQ ID NO: 482270 - DNA, 15 bp, Homo sapiens
aattccgagtctgct

SEQ ID NO: 482271 - DNA, 15 bp, Homo sapiens
attccgagtctgcta

SEQ ID NO: 482272 - DNA, 15 bp, Homo sapiens
ttccgagtctgctag

SEQ ID NO: 482273 - DNA, 15 bp, Homo sapiens
tccgagtctgctaga

SEQ ID NO: 482274 - DNA, 15 bp, Homo sapiens
ccgagtctgctagaa

SEQ ID NO: 482275 - DNA, 15 bp, Homo sapiens
cgagtctgctagaaa

SEQ ID NO: 482276 - DNA, 15 bp, Homo sapiens
gagtctgctagaaag

SEQ ID NO: 482277 - DNA, 15 bp, Homo sapiens
agtctgctagaaagc

SEQ ID NO: 482278 - DNA, 15 bp, Homo sapiens
gtctgctagaaagca

SEQ ID NO: 482279 - DNA, 15 bp, Homo sapiens
tctgctagaaagcat

SEQ ID NO: 482280 - DNA, 15 bp, Homo sapiens
ctgctagaaagcatt

SEQ ID NO: 482281 - DNA, 15 bp, Homo sapiens
tgctagaaagcattt

SEQ ID NO: 482282 - DNA, 15 bp, Homo sapiens
gctagaaagcatttt

SEQ ID NO: 482283 - DNA, 15 bp, Homo sapiens
ctagaaagcattttc

SEQ ID NO: 482284 - DNA, 15 bp, Homo sapiens
tagaaagcattttct

SEQ ID NO: 482285 - DNA, 15 bp, Homo sapiens
agaaagcattttctt

SEQ ID NO: 482286 - DNA, 15 bp, Homo sapiens
gaaagcattttcttg

SEQ ID NO: 482287 - DNA, 15 bp, Homo sapiens
aaagcattttcttgc

SEQ ID NO: 482288 - DNA, 15 bp, Homo sapiens
aagcattttcttgcc

SEQ ID NO: 482289 - DNA, 15 bp, Homo sapiens
agcattttcttgcca

SEQ ID NO: 482290 - DNA, 15 bp, Homo sapiens
gcattttcttgccat

SEQ ID NO: 482291 - DNA, 15 bp, Homo sapiens
cattttcttgccata

SEQ ID NO: 482292 - DNA, 15 bp, Homo sapiens
attttcttgccataa

SEQ ID NO: 482293 - DNA, 15 bp, Homo sapiens
ttttcttgccataaa

SEQ ID NO: 482294 - DNA, 15 bp, Homo sapiens
tttcttgccataaat

SEQ ID NO: 482295 - DNA, 15 bp, Homo sapiens
ttcttgccataaata

SEQ ID NO: 482296 - DNA, 15 bp, Homo sapiens
tcttgccataaatat

SEQ ID NO: 482297 - DNA, 15 bp, Homo sapiens
cttgccataaatata

SEQ ID NO: 482298 - DNA, 15 bp, Homo sapiens
ttgccataaatatat

SEQ ID NO: 482299 - DNA, 15 bp, Homo sapiens
tgccataaatatatc

SEQ ID NO: 482300 - DNA, 15 bp, Homo sapiens
gccataaatatatca

SEQ ID NO: 482301 - DNA, 15 bp, Homo sapiens
ccataaatatatcaa

SEQ ID NO: 482302 - DNA, 15 bp, Homo sapiens
cataaatatatcaac

SEQ ID NO: 482303 - DNA, 15 bp, Homo sapiens
ataaatatatcaact

SEQ ID NO: 482304 - DNA, 15 bp, Homo sapiens
taaatatatcaactt

SEQ ID NO: 482305 - DNA, 15 bp, Homo sapiens
aaatatatcaacttt

SEQ ID NO: 482306 - DNA, 15 bp, Homo sapiens
aatatatcaactttg

SEQ ID NO: 482307 - DNA, 15 bp, Homo sapiens
atatatcaactttgt

SEQ ID NO: 482308 - DNA, 15 bp, Homo sapiens
tatatcaactttgtt

SEQ ID NO: 482309 - DNA, 15 bp, Homo sapiens
atatcaactttgtta

SEQ ID NO: 482310 - DNA, 15 bp, Homo sapiens
tatcaactttgttag

SEQ ID NO: 482311 - DNA, 15 bp, Homo sapiens
atcaactttgttaga

SEQ ID NO: 482312 - DNA, 15 bp, Homo sapiens
tcaactttgttagac

SEQ ID NO: 482313 - DNA, 15 bp, Homo sapiens
caactttgttagaca

SEQ ID NO: 482314 - DNA, 15 bp, Homo sapiens
aactttgttagacat

SEQ ID NO: 482315 - DNA, 15 bp, Homo sapiens
actttgttagacatt

SEQ ID NO: 482316 - DNA, 15 bp, Homo sapiens
ctttgttagacattc

SEQ ID NO: 482317 - DNA, 15 bp, Homo sapiens
tttgttagacattca

SEQ ID NO: 482318 - DNA, 15 bp, Homo sapiens
ttgttagacattcac

SEQ ID NO: 482319 - DNA, 15 bp, Homo sapiens
tgttagacattcact

SEQ ID NO: 482320 - DNA, 15 bp, Homo sapiens
gttagacattcactt

SEQ ID NO: 482321 - DNA, 15 bp, Homo sapiens
ttagacattcactta

SEQ ID NO: 482322 - DNA, 15 bp, Homo sapiens
tagacattcacttat

SEQ ID NO: 482323 - DNA, 15 bp, Homo sapiens
agacattcacttatg

SEQ ID NO: 482324 - DNA, 15 bp, Homo sapiens
gacattcacttatgt

SEQ ID NO: 482325 - DNA, 15 bp, Homo sapiens
acattcacttatgtc

SEQ ID NO: 482326 - DNA, 15 bp, Homo sapiens
cattcacttatgtca

SEQ ID NO: 482327 - DNA, 15 bp, Homo sapiens
attcacttatgtcag

SEQ ID NO: 482328 - DNA, 15 bp, Homo sapiens
ttcacttatgtcagt

SEQ ID NO: 482329 - DNA, 15 bp, Homo sapiens
tcacttatgtcagtt

SEQ ID NO: 482330 - DNA, 15 bp, Homo sapiens
cacttatgtcagtta

SEQ ID NO: 482331 - DNA, 15 bp, Homo sapiens
acttatgtcagttac

SEQ ID NO: 482332 - DNA, 15 bp, Homo sapiens
cttatgtcagttact

SEQ ID NO: 482333 - DNA, 15 bp, Homo sapiens
ttatgtcagttacta

SEQ ID NO: 482334 - DNA, 15 bp, Homo sapiens
tatgtcagttactaa

SEQ ID NO: 482335 - DNA, 15 bp, Homo sapiens
atgtcagttactaat

SEQ ID NO: 482336 - DNA, 15 bp, Homo sapiens
tgtcagttactaatt

SEQ ID NO: 482337 - DNA, 15 bp, Homo sapiens
gtcagttactaattc

SEQ ID NO: 482338 - DNA, 15 bp, Homo sapiens
tcagttactaattca

SEQ ID NO: 482339 - DNA, 15 bp, Homo sapiens
cagttactaattcaa

SEQ ID NO: 482340 - DNA, 15 bp, Homo sapiens
agttactaattcaac

SEQ ID NO: 482341 - DNA, 15 bp, Homo sapiens
gttactaattcaacc

SEQ ID NO: 482342 - DNA, 15 bp, Homo sapiens
ttactaattcaacca

SEQ ID NO: 482343 - DNA, 15 bp, Homo sapiens
tactaattcaaccac

SEQ ID NO: 482344 - DNA, 15 bp, Homo sapiens
actaattcaaccacg

SEQ ID NO: 482345 - DNA, 15 bp, Homo sapiens
ctaattcaaccacgt

SEQ ID NO: 482346 - DNA, 15 bp, Homo sapiens
taattcaaccacgtt

SEQ ID NO: 482347 - DNA, 15 bp, Homo sapiens
aattcaaccacgtta

SEQ ID NO: 482348 - DNA, 15 bp, Homo sapiens
attcaaccacgttac

SEQ ID NO: 482349 - DNA, 15 bp, Homo sapiens
ttcaaccacgttact

SEQ ID NO: 482350 - DNA, 15 bp, Homo sapiens
tcaaccacgttactg

SEQ ID NO: 482351 - DNA, 15 bp, Homo sapiens
caaccacgttactgc

SEQ ID NO: 482352 - DNA, 15 bp, Homo sapiens
aaccacgttactgct

SEQ ID NO: 482353 - DNA, 15 bp, Homo sapiens
accacgttactgcta

SEQ ID NO: 482354 - DNA, 15 bp, Homo sapiens
ccacgttactgctat

SEQ ID NO: 482355 - DNA, 15 bp, Homo sapiens
cacgttactgctatg

SEQ ID NO: 482356 - DNA, 15 bp, Homo sapiens
acgttactgctatgt

SEQ ID NO: 482357 - DNA, 15 bp, Homo sapiens
cgttactgctatgtc

SEQ ID NO: 482358 - DNA, 15 bp, Homo sapiens
gttactgctatgtct

SEQ ID NO: 482359 - DNA, 15 bp, Homo sapiens
ttactgctatgtcta

SEQ ID NO: 482360 - DNA, 15 bp, Homo sapiens
tactgctatgtctag

SEQ ID NO: 482361 - DNA, 15 bp, Homo sapiens
actgctatgtctagt

SEQ ID NO: 482362 - DNA, 15 bp, Homo sapiens
ctgctatgtctagtt

SEQ ID NO: 482363 - DNA, 15 bp, Homo sapiens
tgctatgtctagttc

SEQ ID NO: 482364 - DNA, 15 bp, Homo sapiens
gctatgtctagttca

SEQ ID NO: 482365 - DNA, 15 bp, Homo sapiens
ctatgtctagttcat

SEQ ID NO: 482366 - DNA, 15 bp, Homo sapiens
tatgtctagttcatt

SEQ ID NO: 482367 - DNA, 15 bp, Homo sapiens
atgtctagttcatta

SEQ ID NO: 482368 - DNA, 15 bp, Homo sapiens
tgtctagttcattag

SEQ ID NO: 482369 - DNA, 15 bp, Homo sapiens
gtctagttcattaga

SEQ ID NO: 482370 - DNA, 15 bp, Homo sapiens
tctagttcattagac

SEQ ID NO: 482371 - DNA, 15 bp, Homo sapiens
ctagttcattagaca

SEQ ID NO: 482372 - DNA, 15 bp, Homo sapiens
tagttcattagacag

SEQ ID NO: 482373 - DNA, 15 bp, Homo sapiens
agttcattagacagg

SEQ ID NO: 482374 - DNA, 15 bp, Homo sapiens
gttcattagacaggt

SEQ ID NO: 482375 - DNA, 15 bp, Homo sapiens
ttcattagacaggta

SEQ ID NO: 482376 - DNA, 15 bp, Homo sapiens
tcattagacaggtag

SEQ ID NO: 482377 - DNA, 15 bp, Homo sapiens
cattagacaggtagt

SEQ ID NO: 482378 - DNA, 15 bp, Homo sapiens
attagacaggtagtt

SEQ ID NO: 482379 - DNA, 15 bp, Homo sapiens
ttagacaggtagtta

SEQ ID NO: 482380 - DNA, 15 bp, Homo sapiens
tagacaggtagttag

SEQ ID NO: 482381 - DNA, 15 bp, Homo sapiens
agacaggtagttaga

SEQ ID NO: 482382 - DNA, 15 bp, Homo sapiens
gacaggtagttagat

SEQ ID NO: 482383 - DNA, 15 bp, Homo sapiens
acaggtagttagata

SEQ ID NO: 482384 - DNA, 15 bp, Homo sapiens
caggtagttagataa

SEQ ID NO: 482385 - DNA, 15 bp, Homo sapiens
aggtagttagataag

SEQ ID NO: 482386 - DNA, 15 bp, Homo sapiens
ggtagttagataagt

SEQ ID NO: 482387 - DNA, 15 bp, Homo sapiens
gtagttagataagtg

SEQ ID NO: 482388 - DNA, 15 bp, Homo sapiens
tagttagataagtgg

SEQ ID NO: 482389 - DNA, 15 bp, Homo sapiens
agttagataagtggg

SEQ ID NO: 482390 - DNA, 15 bp, Homo sapiens
gttagataagtggga

SEQ ID NO: 482391 - DNA, 15 bp, Homo sapiens
ttagataagtgggag

SEQ ID NO: 482392 - DNA, 15 bp, Homo sapiens
tagataagtgggaga

SEQ ID NO: 482393 - DNA, 15 bp, Homo sapiens
agataagtgggagaa

SEQ ID NO: 482394 - DNA, 15 bp, Homo sapiens
gataagtgggagaac

SEQ ID NO: 482395 - DNA, 15 bp, Homo sapiens
ataagtgggagaacc

SEQ ID NO: 482396 - DNA, 15 bp, Homo sapiens
taagtgggagaaccc

SEQ ID NO: 482397 - DNA, 15 bp, Homo sapiens
aagtgggagaaccca

SEQ ID NO: 482398 - DNA, 15 bp, Homo sapiens
agtgggagaacccac

SEQ ID NO: 482399 - DNA, 15 bp, Homo sapiens
gtgggagaacccaca

SEQ ID NO: 482400 - DNA, 15 bp, Homo sapiens
tgggagaacccacat

SEQ ID NO: 482401 - DNA, 15 bp, Homo sapiens
gggagaacccacatg

SEQ ID NO: 482402 - DNA, 15 bp, Homo sapiens
ggagaacccacatgc

SEQ ID NO: 482403 - DNA, 15 bp, Homo sapiens
gagaacccacatgca

SEQ ID NO: 482404 - DNA, 15 bp, Homo sapiens
agaacccacatgcat

SEQ ID NO: 482405 - DNA, 15 bp, Homo sapiens
gaacccacatgcatt

SEQ ID NO: 482406 - DNA, 15 bp, Homo sapiens
aacccacatgcatta

SEQ ID NO: 482407 - DNA, 15 bp, Homo sapiens
acccacatgcattaa

SEQ ID NO: 482408 - DNA, 15 bp, Homo sapiens
cccacatgcattaaa

SEQ ID NO: 482409 - DNA, 15 bp, Homo sapiens
ccacatgcattaaat

SEQ ID NO: 482410 - DNA, 15 bp, Homo sapiens
cacatgcattaaatg

SEQ ID NO: 482411 - DNA, 15 bp, Homo sapiens
acatgcattaaatgt

SEQ ID NO: 482412 - DNA, 15 bp, Homo sapiens
catgcattaaatgta

SEQ ID NO: 482413 - DNA, 15 bp, Homo sapiens
atgcattaaatgtag

SEQ ID NO: 482414 - DNA, 15 bp, Homo sapiens
tgcattaaatgtagt

SEQ ID NO: 482415 - DNA, 15 bp, Homo sapiens
gcattaaatgtagtt

SEQ ID NO: 482416 - DNA, 15 bp, Homo sapiens
cattaaatgtagttt

SEQ ID NO: 482417 - DNA, 15 bp, Homo sapiens
attaaatgtagtttc

SEQ ID NO: 482418 - DNA, 15 bp, Homo sapiens
ttaaatgtagtttct

SEQ ID NO: 482419 - DNA, 15 bp, Homo sapiens
taaatgtagtttctt

SEQ ID NO: 482420 - DNA, 15 bp, Homo sapiens
aaatgtagtttcttg

SEQ ID NO: 482421 - DNA, 15 bp, Homo sapiens
aatgtagtttcttgt

SEQ ID NO: 482422 - DNA, 15 bp, Homo sapiens
atgtagtttcttgtt

SEQ ID NO: 482423 - DNA, 15 bp, Homo sapiens
tgtagtttcttgttc

SEQ ID NO: 482424 - DNA, 15 bp, Homo sapiens
gtagtttcttgttct

SEQ ID NO: 482425 - DNA, 15 bp, Homo sapiens
tagtttcttgttcta

SEQ ID NO: 482426 - DNA, 15 bp, Homo sapiens
agtttcttgttctaa

SEQ ID NO: 482427 - DNA, 15 bp, Homo sapiens
gtttcttgttctaat

SEQ ID NO: 482428 - DNA, 15 bp, Homo sapiens
tttcttgttctaatg

SEQ ID NO: 482429 - DNA, 15 bp, Homo sapiens
ttcttgttctaatgc

SEQ ID NO: 482430 - DNA, 15 bp, Homo sapiens
tcttgttctaatgca

SEQ ID NO: 482431 - DNA, 15 bp, Homo sapiens
cttgttctaatgcag

SEQ ID NO: 482432 - DNA, 15 bp, Homo sapiens
ttgttctaatgcaga

SEQ ID NO: 482433 - DNA, 15 bp, Homo sapiens
tgttctaatgcagag

SEQ ID NO: 482434 - DNA, 15 bp, Homo sapiens
gttctaatgcagagt

SEQ ID NO: 482435 - DNA, 15 bp, Homo sapiens
ttctaatgcagagtg

SEQ ID NO: 482436 - DNA, 15 bp, Homo sapiens
tctaatgcagagtga

SEQ ID NO: 482437 - DNA, 15 bp, Homo sapiens
ctaatgcagagtgat

SEQ ID NO: 482438 - DNA, 15 bp, Homo sapiens
taatgcagagtgatc

SEQ ID NO: 482439 - DNA, 15 bp, Homo sapiens
aatgcagagtgatca

SEQ ID NO: 482440 - DNA, 15 bp, Homo sapiens
atgcagagtgatcaa

SEQ ID NO: 482441 - DNA, 15 bp, Homo sapiens
tgcagagtgatcaac

SEQ ID NO: 482442 - DNA, 15 bp, Homo sapiens
gcagagtgatcaacc

SEQ ID NO: 482443 - DNA, 15 bp, Homo sapiens
cagagtgatcaaccc

SEQ ID NO: 482444 - DNA, 15 bp, Homo sapiens
agagtgatcaaccct

SEQ ID NO: 482445 - DNA, 15 bp, Homo sapiens
gagtgatcaacccta

SEQ ID NO: 482446 - DNA, 15 bp, Homo sapiens
agtgatcaaccctaa

SEQ ID NO: 482447 - DNA, 15 bp, Homo sapiens
gtgatcaaccctaaa

SEQ ID NO: 482448 - DNA, 15 bp, Homo sapiens
tgatcaaccctaaaa

SEQ ID NO: 482449 - DNA, 15 bp, Homo sapiens
gatcaaccctaaaaa

SEQ ID NO: 482450 - DNA, 15 bp, Homo sapiens
atcaaccctaaaaat

SEQ ID NO: 482451 - DNA, 15 bp, Homo sapiens
tcaaccctaaaaatg

SEQ ID NO: 482452 - DNA, 15 bp, Homo sapiens
caaccctaaaaatga

SEQ ID NO: 482453 - DNA, 15 bp, Homo sapiens
aaccctaaaaatgac

SEQ ID NO: 482454 - DNA, 15 bp, Homo sapiens
accctaaaaatgacc

SEQ ID NO: 482455 - DNA, 15 bp, Homo sapiens
ccctaaaaatgacct

SEQ ID NO: 482456 - DNA, 15 bp, Homo sapiens
cctaaaaatgacctg

SEQ ID NO: 482457 - DNA, 15 bp, Homo sapiens
ctaaaaatgacctgc

SEQ ID NO: 482458 - DNA, 15 bp, Homo sapiens
taaaaatgacctgct

SEQ ID NO: 482459 - DNA, 15 bp, Homo sapiens
aaaaatgacctgcta

SEQ ID NO: 482460 - DNA, 15 bp, Homo sapiens
aaaatgacctgctaa

SEQ ID NO: 482461 - DNA, 15 bp, Homo sapiens
aaatgacctgctaat

SEQ ID NO: 482462 - DNA, 15 bp, Homo sapiens
aatgacctgctaata

SEQ ID NO: 482463 - DNA, 15 bp, Homo sapiens
atgacctgctaataa

SEQ ID NO: 482464 - DNA, 15 bp, Homo sapiens
tgacctgctaataat

SEQ ID NO: 482465 - DNA, 15 bp, Homo sapiens
gacctgctaataata

SEQ ID NO: 482466 - DNA, 15 bp, Homo sapiens
acctgctaataatat

SEQ ID NO: 482467 - DNA, 15 bp, Homo sapiens
cctgctaataatata

SEQ ID NO: 482468 - DNA, 15 bp, Homo sapiens
ctgctaataatataa

SEQ ID NO: 482469 - DNA, 15 bp, Homo sapiens
tgctaataatataaa

SEQ ID NO: 482470 - DNA, 15 bp, Homo sapiens
gctaataatataaag

SEQ ID NO: 482471 - DNA, 15 bp, Homo sapiens
ctaataatataaagt

SEQ ID NO: 482472 - DNA, 15 bp, Homo sapiens
taataatataaagta

SEQ ID NO: 482473 - DNA, 15 bp, Homo sapiens
aataatataaagtaa

SEQ ID NO: 482474 - DNA, 15 bp, Homo sapiens
ataatataaagtaaa

SEQ ID NO: 482475 - DNA, 15 bp, Homo sapiens
taatataaagtaaaa

SEQ ID NO: 482476 - DNA, 15 bp, Homo sapiens
aatataaagtaaaat

SEQ ID NO: 482477 - DNA, 15 bp, Homo sapiens
atataaagtaaaata

SEQ ID NO: 482478 - DNA, 15 bp, Homo sapiens
tataaagtaaaatat

SEQ ID NO: 482479 - DNA, 15 bp, Homo sapiens
ataaagtaaaatatc

SEQ ID NO: 482480 - DNA, 15 bp, Homo sapiens
taaagtaaaatatct

SEQ ID NO: 482481 - DNA, 15 bp, Homo sapiens
aaagtaaaatatctg

SEQ ID NO: 482482 - DNA, 15 bp, Homo sapiens
aagtaaaatatctgt

SEQ ID NO: 482483 - DNA, 15 bp, Homo sapiens
agtaaaatatctgta

SEQ ID NO: 482484 - DNA, 15 bp, Homo sapiens
gtaaaatatctgtag

SEQ ID NO: 482485 - DNA, 15 bp, Homo sapiens
taaaatatctgtaga

SEQ ID NO: 482486 - DNA, 15 bp, Homo sapiens
aaaatatctgtagag

SEQ ID NO: 482487 - DNA, 15 bp, Homo sapiens
aaatatctgtagaga

SEQ ID NO: 482488 - DNA, 15 bp, Homo sapiens
aatatctgtagagac

SEQ ID NO: 482489 - DNA, 15 bp, Homo sapiens
atatctgtagagaca

SEQ ID NO: 482490 - DNA, 15 bp, Homo sapiens
tatctgtagagacat

SEQ ID NO: 482491 - DNA, 15 bp, Homo sapiens
atctgtagagacatt

SEQ ID NO: 482492 - DNA, 15 bp, Homo sapiens
tctgtagagacatta

SEQ ID NO: 482493 - DNA, 15 bp, Homo sapiens
ctgtagagacattat

SEQ ID NO: 482494 - DNA, 15 bp, Homo sapiens
tgtagagacattata

SEQ ID NO: 482495 - DNA, 15 bp, Homo sapiens
gtagagacattataa

SEQ ID NO: 482496 - DNA, 15 bp, Homo sapiens
tagagacattataaa

SEQ ID NO: 482497 - DNA, 15 bp, Homo sapiens
agagacattataaat

SEQ ID NO: 482498 - DNA, 15 bp, Homo sapiens
gagacattataaata

SEQ ID NO: 482499 - DNA, 15 bp, Homo sapiens
agacattataaatat

SEQ ID NO: 482500 - DNA, 15 bp, Homo sapiens
gacattataaatatc

SEQ ID NO: 482501 - DNA, 15 bp, Homo sapiens
acattataaatatct

SEQ ID NO: 482502 - DNA, 15 bp, Homo sapiens
cattataaatatcta

SEQ ID NO: 482503 - DNA, 15 bp, Homo sapiens
attataaatatctac

SEQ ID NO: 482504 - DNA, 15 bp, Homo sapiens
ttataaatatctaca

SEQ ID NO: 482505 - DNA, 15 bp, Homo sapiens
tataaatatctacaa

SEQ ID NO: 482506 - DNA, 15 bp, Homo sapiens
ataaatatctacaat

SEQ ID NO: 482507 - DNA, 15 bp, Homo sapiens
taaatatctacaatt

SEQ ID NO: 482508 - DNA, 15 bp, Homo sapiens
aaatatctacaatta

SEQ ID NO: 482509 - DNA, 15 bp, Homo sapiens
aatatctacaattat

SEQ ID NO: 482510 - DNA, 15 bp, Homo sapiens
atatctacaattata

SEQ ID NO: 482511 - DNA, 15 bp, Homo sapiens
tatctacaattataa

SEQ ID NO: 482512 - DNA, 15 bp, Homo sapiens
atctacaattataat

SEQ ID NO: 482513 - DNA, 15 bp, Homo sapiens
tctacaattataatt

SEQ ID NO: 482514 - DNA, 15 bp, Homo sapiens
ctacaattataattt

SEQ ID NO: 482515 - DNA, 15 bp, Homo sapiens
tacaattataatttg

SEQ ID NO: 482516 - DNA, 15 bp, Homo sapiens
acaattataatttgt

SEQ ID NO: 482517 - DNA, 15 bp, Homo sapiens
caattataatttgtg

SEQ ID NO: 482518 - DNA, 15 bp, Homo sapiens
aattataatttgtgc

SEQ ID NO: 482519 - DNA, 15 bp, Homo sapiens
attataatttgtgct

SEQ ID NO: 482520 - DNA, 15 bp, Homo sapiens
ttataatttgtgctg

SEQ ID NO: 482521 - DNA, 15 bp, Homo sapiens
tataatttgtgctga

SEQ ID NO: 482522 - DNA, 15 bp, Homo sapiens
ataatttgtgctgag

SEQ ID NO: 482523 - DNA, 15 bp, Homo sapiens
taatttgtgctgagc

SEQ ID NO: 482524 - DNA, 15 bp, Homo sapiens
aatttgtgctgagct

SEQ ID NO: 482525 - DNA, 15 bp, Homo sapiens
atttgtgctgagcta

SEQ ID NO: 482526 - DNA, 15 bp, Homo sapiens
tttgtgctgagctat

SEQ ID NO: 482527 - DNA, 15 bp, Homo sapiens
ttgtgctgagctatt

SEQ ID NO: 482528 - DNA, 15 bp, Homo sapiens
tgtgctgagctattt

SEQ ID NO: 482529 - DNA, 15 bp, Homo sapiens
gtgctgagctattta

SEQ ID NO: 482530 - DNA, 15 bp, Homo sapiens
tgctgagctatttaa

SEQ ID NO: 482531 - DNA, 15 bp, Homo sapiens
gctgagctatttaaa

SEQ ID NO: 482532 - DNA, 15 bp, Homo sapiens
ctgagctatttaaat

SEQ ID NO: 482533 - DNA, 15 bp, Homo sapiens
tgagctatttaaata

SEQ ID NO: 482534 - DNA, 15 bp, Homo sapiens
gagctatttaaataa

SEQ ID NO: 482535 - DNA, 15 bp, Homo sapiens
agctatttaaataaa

SEQ ID NO: 482536 - DNA, 15 bp, Homo sapiens
gctatttaaataaaa

SEQ ID NO: 482537 - DNA, 15 bp, Homo sapiens
ctatttaaataaaag

SEQ ID NO: 482538 - DNA, 15 bp, Homo sapiens
tatttaaataaaaga

SEQ ID NO: 482539 - DNA, 15 bp, Homo sapiens
atttaaataaaagaa

SEQ ID NO: 482540 - DNA, 15 bp, Homo sapiens
tttaaataaaagaac

SEQ ID NO: 482541 - DNA, 15 bp, Homo sapiens
ttaaataaaagaaca

SEQ ID NO: 482542 - DNA, 15 bp, Homo sapiens
taaataaaagaacat

SEQ ID NO: 482543 - DNA, 15 bp, Homo sapiens
aaataaaagaacata

SEQ ID NO: 482544 - DNA, 15 bp, Homo sapiens
aataaaagaacataa

SEQ ID NO: 482545 - DNA, 15 bp, Homo sapiens
ataaaagaacataag

SEQ ID NO: 482546 - DNA, 15 bp, Homo sapiens
taaaagaacataagg

SEQ ID NO: 482547 - DNA, 15 bp, Homo sapiens
aaaagaacataagga

SEQ ID NO: 482548 - DNA, 15 bp, Homo sapiens
aaagaacataaggat

SEQ ID NO: 482549 - DNA, 15 bp, Homo sapiens
aagaacataaggatt

SEQ ID NO: 482550 - DNA, 15 bp, Homo sapiens
agaacataaggatta

SEQ ID NO: 482551 - DNA, 15 bp, Homo sapiens
gaacataaggattat

SEQ ID NO: 482552 - DNA, 15 bp, Homo sapiens
aacataaggattata

SEQ ID NO: 482553 - DNA, 15 bp, Homo sapiens
acataaggattataa

SEQ ID NO: 482554 - DNA, 15 bp, Homo sapiens
cataaggattataaa

SEQ ID NO: 482555 - DNA, 15 bp, Homo sapiens
ataaggattataaac

SEQ ID NO: 482556 - DNA, 15 bp, Homo sapiens
taaggattataaacc

SEQ ID NO: 482557 - DNA, 15 bp, Homo sapiens
aaggattataaacct

SEQ ID NO: 482558 - DNA, 15 bp, Homo sapiens
aggattataaacctt

SEQ ID NO: 482559 - DNA, 15 bp, Homo sapiens
ggattataaaccttg

SEQ ID NO: 482560 - DNA, 15 bp, Homo sapiens
gattataaaccttgt

SEQ ID NO: 482561 - DNA, 15 bp, Homo sapiens
attataaaccttgtc

SEQ ID NO: 482562 - DNA, 15 bp, Homo sapiens
ttataaaccttgtca

SEQ ID NO: 482563 - DNA, 15 bp, Homo sapiens
tataaaccttgtcat

SEQ ID NO: 482564 - DNA, 15 bp, Homo sapiens
ataaaccttgtcata

SEQ ID NO: 482565 - DNA, 15 bp, Homo sapiens
taaaccttgtcatat

SEQ ID NO: 482566 - DNA, 15 bp, Homo sapiens
aaaccttgtcatatg

SEQ ID NO: 482567 - DNA, 15 bp, Homo sapiens
aaccttgtcatatgg

SEQ ID NO: 482568 - DNA, 15 bp, Homo sapiens
accttgtcatatggg

SEQ ID NO: 482569 - DNA, 15 bp, Homo sapiens
ccttgtcatatgggt

SEQ ID NO: 482570 - DNA, 15 bp, Homo sapiens
cttgtcatatgggtt

SEQ ID NO: 482571 - DNA, 15 bp, Homo sapiens
ttgtcatatgggtta

SEQ ID NO: 482572 - DNA, 15 bp, Homo sapiens
tgtcatatgggttac

SEQ ID NO: 482573 - DNA, 15 bp, Homo sapiens
gtcatatgggttaca

SEQ ID NO: 482574 - DNA, 15 bp, Homo sapiens
tcatatgggttacaa

SEQ ID NO: 482575 - DNA, 15 bp, Homo sapiens
catatgggttacaaa

SEQ ID NO: 482576 - DNA, 15 bp, Homo sapiens
atatgggttacaaag

SEQ ID NO: 482577 - DNA, 15 bp, Homo sapiens
tatgggttacaaagc

SEQ ID NO: 482578 - DNA, 15 bp, Homo sapiens
atgggttacaaagca

SEQ ID NO: 482579 - DNA, 15 bp, Homo sapiens
tgggttacaaagcat

SEQ ID NO: 482580 - DNA, 15 bp, Homo sapiens
gggttacaaagcatt

SEQ ID NO: 482581 - DNA, 15 bp, Homo sapiens
ggttacaaagcattt

SEQ ID NO: 482582 - DNA, 15 bp, Homo sapiens
gttacaaagcatttc

SEQ ID NO: 482583 - DNA, 15 bp, Homo sapiens
ttacaaagcatttca

SEQ ID NO: 482584 - DNA, 15 bp, Homo sapiens
tacaaagcatttcaa

SEQ ID NO: 482585 - DNA, 15 bp, Homo sapiens
acaaagcatttcaaa

SEQ ID NO: 482586 - DNA, 15 bp, Homo sapiens
caaagcatttcaaag

SEQ ID NO: 482587 - DNA, 15 bp, Homo sapiens
aaagcatttcaaagt

SEQ ID NO: 482588 - DNA, 15 bp, Homo sapiens
aagcatttcaaagtt

SEQ ID NO: 482589 - DNA, 15 bp, Homo sapiens
agcatttcaaagtta

SEQ ID NO: 482590 - DNA, 15 bp, Homo sapiens
gcatttcaaagttac

SEQ ID NO: 482591 - DNA, 15 bp, Homo sapiens
catttcaaagttact

SEQ ID NO: 482592 - DNA, 15 bp, Homo sapiens
atttcaaagttactt

SEQ ID NO: 482593 - DNA, 15 bp, Homo sapiens
tttcaaagttacttt

SEQ ID NO: 482594 - DNA, 15 bp, Homo sapiens
ttcaaagttactttc

SEQ ID NO: 482595 - DNA, 15 bp, Homo sapiens
tcaaagttactttca

SEQ ID NO: 482596 - DNA, 15 bp, Homo sapiens
caaagttactttcaa

SEQ ID NO: 482597 - DNA, 15 bp, Homo sapiens
aaagttactttcaac

SEQ ID NO: 482598 - DNA, 15 bp, Homo sapiens
aagttactttcaacg

SEQ ID NO: 482599 - DNA, 15 bp, Homo sapiens
agttactttcaacga

SEQ ID NO: 482600 - DNA, 15 bp, Homo sapiens
gttactttcaacgaa

SEQ ID NO: 482601 - DNA, 15 bp, Homo sapiens
ttactttcaacgaaa

SEQ ID NO: 482602 - DNA, 15 bp, Homo sapiens
tactttcaacgaaat

SEQ ID NO: 482603 - DNA, 15 bp, Homo sapiens
actttcaacgaaatt

SEQ ID NO: 482604 - DNA, 15 bp, Homo sapiens
ctttcaacgaaattc

SEQ ID NO: 482605 - DNA, 15 bp, Homo sapiens
tttcaacgaaattct

SEQ ID NO: 482606 - DNA, 15 bp, Homo sapiens
ttcaacgaaattcta

SEQ ID NO: 482607 - DNA, 15 bp, Homo sapiens
tcaacgaaattctaa

SEQ ID NO: 482608 - DNA, 15 bp, Homo sapiens
caacgaaattctaaa

SEQ ID NO: 482609 - DNA, 15 bp, Homo sapiens
aacgaaattctaaag

SEQ ID NO: 482610 - DNA, 15 bp, Homo sapiens
acgaaattctaaaga

SEQ ID NO: 482611 - DNA, 15 bp, Homo sapiens
cgaaattctaaagac

SEQ ID NO: 482612 - DNA, 15 bp, Homo sapiens
gaaattctaaagaca

SEQ ID NO: 482613 - DNA, 15 bp, Homo sapiens
aaattctaaagacag

SEQ ID NO: 482614 - DNA, 15 bp, Homo sapiens
aattctaaagacagt

SEQ ID NO: 482615 - DNA, 15 bp, Homo sapiens
attctaaagacagtg

SEQ ID NO: 482616 - DNA, 15 bp, Homo sapiens
ttctaaagacagtga

SEQ ID NO: 482617 - DNA, 15 bp, Homo sapiens
tctaaagacagtgaa

SEQ ID NO: 482618 - DNA, 15 bp, Homo sapiens
ctaaagacagtgaag

SEQ ID NO: 482619 - DNA, 15 bp, Homo sapiens
taaagacagtgaagt

SEQ ID NO: 482620 - DNA, 15 bp, Homo sapiens
aaagacagtgaagtc

SEQ ID NO: 482621 - DNA, 15 bp, Homo sapiens
aagacagtgaagtca

SEQ ID NO: 482622 - DNA, 15 bp, Homo sapiens
agacagtgaagtcag

SEQ ID NO: 482623 - DNA, 15 bp, Homo sapiens
gacagtgaagtcaga

SEQ ID NO: 482624 - DNA, 15 bp, Homo sapiens
acagtgaagtcagat

SEQ ID NO: 482625 - DNA, 15 bp, Homo sapiens
cagtgaagtcagatg

SEQ ID NO: 482626 - DNA, 15 bp, Homo sapiens
agtgaagtcagatga

SEQ ID NO: 482627 - DNA, 15 bp, Homo sapiens
gtgaagtcagatgat

SEQ ID NO: 482628 - DNA, 15 bp, Homo sapiens
tgaagtcagatgatt

SEQ ID NO: 482629 - DNA, 15 bp, Homo sapiens
gaagtcagatgattc

SEQ ID NO: 482630 - DNA, 15 bp, Homo sapiens
aagtcagatgattct

SEQ ID NO: 482631 - DNA, 15 bp, Homo sapiens
agtcagatgattctt

SEQ ID NO: 482632 - DNA, 15 bp, Homo sapiens
gtcagatgattctta

SEQ ID NO: 482633 - DNA, 15 bp, Homo sapiens
tcagatgattcttaa

SEQ ID NO: 482634 - DNA, 15 bp, Homo sapiens
cagatgattcttaat

SEQ ID NO: 482635 - DNA, 15 bp, Homo sapiens
agatgattcttaatt

SEQ ID NO: 482636 - DNA, 15 bp, Homo sapiens
gatgattcttaattc

SEQ ID NO: 482637 - DNA, 15 bp, Homo sapiens
atgattcttaattca

SEQ ID NO: 482638 - DNA, 15 bp, Homo sapiens
tgattcttaattcag

SEQ ID NO: 482639 - DNA, 15 bp, Homo sapiens
gattcttaattcagt

SEQ ID NO: 482640 - DNA, 15 bp, Homo sapiens
attcttaattcagta

SEQ ID NO: 482641 - DNA, 15 bp, Homo sapiens
ttcttaattcagtag

SEQ ID NO: 482642 - DNA, 15 bp, Homo sapiens
tcttaattcagtagt

SEQ ID NO: 482643 - DNA, 15 bp, Homo sapiens
cttaattcagtagtc

SEQ ID NO: 482644 - DNA, 15 bp, Homo sapiens
ttaattcagtagtct

SEQ ID NO: 482645 - DNA, 15 bp, Homo sapiens
taattcagtagtctt

SEQ ID NO: 482646 - DNA, 15 bp, Homo sapiens
aattcagtagtcttt

SEQ ID NO: 482647 - DNA, 15 bp, Homo sapiens
attcagtagtctttt

SEQ ID NO: 482648 - DNA, 15 bp, Homo sapiens
ttcagtagtctttta

SEQ ID NO: 482649 - DNA, 15 bp, Homo sapiens
tcagtagtcttttaa

SEQ ID NO: 482650 - DNA, 15 bp, Homo sapiens
cagtagtcttttaat

SEQ ID NO: 482651 - DNA, 15 bp, Homo sapiens
agtagtcttttaatc

SEQ ID NO: 482652 - DNA, 15 bp, Homo sapiens
gtagtcttttaatca

SEQ ID NO: 482653 - DNA, 15 bp, Homo sapiens
tagtcttttaatcaa

SEQ ID NO: 482654 - DNA, 15 bp, Homo sapiens
agtcttttaatcaac

SEQ ID NO: 482655 - DNA, 15 bp, Homo sapiens
gtcttttaatcaact

SEQ ID NO: 482656 - DNA, 15 bp, Homo sapiens
tcttttaatcaactc

SEQ ID NO: 482657 - DNA, 15 bp, Homo sapiens
cttttaatcaactct

SEQ ID NO: 482658 - DNA, 15 bp, Homo sapiens
ttttaatcaactctt

SEQ ID NO: 482659 - DNA, 15 bp, Homo sapiens
tttaatcaactcttt

SEQ ID NO: 482660 - DNA, 15 bp, Homo sapiens
ttaatcaactcttta

SEQ ID NO: 482661 - DNA, 15 bp, Homo sapiens
taatcaactctttag

SEQ ID NO: 482662 - DNA, 15 bp, Homo sapiens
aatcaactctttagg

SEQ ID NO: 482663 - DNA, 15 bp, Homo sapiens
atcaactctttaggc

SEQ ID NO: 482664 - DNA, 15 bp, Homo sapiens
tcaactctttaggca

SEQ ID NO: 482665 - DNA, 15 bp, Homo sapiens
caactctttaggcat

SEQ ID NO: 482666 - DNA, 15 bp, Homo sapiens
aactctttaggcatg

SEQ ID NO: 482667 - DNA, 15 bp, Homo sapiens
actctttaggcatgg

SEQ ID NO: 482668 - DNA, 15 bp, Homo sapiens
ctctttaggcatgga

SEQ ID NO: 482669 - DNA, 15 bp, Homo sapiens
tctttaggcatggag

SEQ ID NO: 482670 - DNA, 15 bp, Homo sapiens
ctttaggcatggagt

SEQ ID NO: 482671 - DNA, 15 bp, Homo sapiens
tttaggcatggagta

SEQ ID NO: 482672 - DNA, 15 bp, Homo sapiens
ttaggcatggagtaa

SEQ ID NO: 482673 - DNA, 15 bp, Homo sapiens
taggcatggagtaat

SEQ ID NO: 482674 - DNA, 15 bp, Homo sapiens
aggcatggagtaatt

SEQ ID NO: 482675 - DNA, 15 bp, Homo sapiens
ggcatggagtaattg

SEQ ID NO: 482676 - DNA, 15 bp, Homo sapiens
gcatggagtaattga

SEQ ID NO: 482677 - DNA, 15 bp, Homo sapiens
catggagtaattgat

SEQ ID NO: 482678 - DNA, 15 bp, Homo sapiens
atggagtaattgatt

SEQ ID NO: 482679 - DNA, 15 bp, Homo sapiens
tggagtaattgattt

SEQ ID NO: 482680 - DNA, 15 bp, Homo sapiens
ggagtaattgatttt

SEQ ID NO: 482681 - DNA, 15 bp, Homo sapiens
gagtaattgattttg

SEQ ID NO: 482682 - DNA, 15 bp, Homo sapiens
agtaattgattttgt

SEQ ID NO: 482683 - DNA, 15 bp, Homo sapiens
gtaattgattttgtc

SEQ ID NO: 482684 - DNA, 15 bp, Homo sapiens
taattgattttgtct

SEQ ID NO: 482685 - DNA, 15 bp, Homo sapiens
aattgattttgtcta

SEQ ID NO: 482686 - DNA, 15 bp, Homo sapiens
attgattttgtctac

SEQ ID NO: 482687 - DNA, 15 bp, Homo sapiens
ttgattttgtctaca

SEQ ID NO: 482688 - DNA, 15 bp, Homo sapiens
tgattttgtctacag

SEQ ID NO: 482689 - DNA, 15 bp, Homo sapiens
gattttgtctacagt

SEQ ID NO: 482690 - DNA, 15 bp, Homo sapiens
attttgtctacagta

SEQ ID NO: 482691 - DNA, 15 bp, Homo sapiens
ttttgtctacagtag

SEQ ID NO: 482692 - DNA, 15 bp, Homo sapiens
tttgtctacagtagc

SEQ ID NO: 482693 - DNA, 15 bp, Homo sapiens
ttgtctacagtagct

SEQ ID NO: 482694 - DNA, 15 bp, Homo sapiens
tgtctacagtagctt

SEQ ID NO: 482695 - DNA, 15 bp, Homo sapiens
gtctacagtagcttt

SEQ ID NO: 482696 - DNA, 15 bp, Homo sapiens
tctacagtagctttt

SEQ ID NO: 482697 - DNA, 15 bp, Homo sapiens
ctacagtagctttta

SEQ ID NO: 482698 - DNA, 15 bp, Homo sapiens
tacagtagcttttat

SEQ ID NO: 482699 - DNA, 15 bp, Homo sapiens
acagtagcttttata

SEQ ID NO: 482700 - DNA, 15 bp, Homo sapiens
cagtagcttttatac

SEQ ID NO: 482701 - DNA, 15 bp, Homo sapiens
agtagcttttatact

SEQ ID NO: 482702 - DNA, 15 bp, Homo sapiens
gtagcttttatacta

SEQ ID NO: 482703 - DNA, 15 bp, Homo sapiens
tagcttttatactaa

SEQ ID NO: 482704 - DNA, 15 bp, Homo sapiens
agcttttatactaaa

SEQ ID NO: 482705 - DNA, 15 bp, Homo sapiens
gcttttatactaaat

SEQ ID NO: 482706 - DNA, 15 bp, Homo sapiens
cttttatactaaatg

SEQ ID NO: 482707 - DNA, 15 bp, Homo sapiens
ttttatactaaatgc

SEQ ID NO: 482708 - DNA, 15 bp, Homo sapiens
tttatactaaatgct

SEQ ID NO: 482709 - DNA, 15 bp, Homo sapiens
ttatactaaatgctg

SEQ ID NO: 482710 - DNA, 15 bp, Homo sapiens
tatactaaatgctgt

SEQ ID NO: 482711 - DNA, 15 bp, Homo sapiens
atactaaatgctgtt

SEQ ID NO: 482712 - DNA, 15 bp, Homo sapiens
tactaaatgctgttc

SEQ ID NO: 482713 - DNA, 15 bp, Homo sapiens
actaaatgctgttcc

SEQ ID NO: 482714 - DNA, 15 bp, Homo sapiens
ctaaatgctgttcct

SEQ ID NO: 482715 - DNA, 15 bp, Homo sapiens
taaatgctgttcctt

SEQ ID NO: 482716 - DNA, 15 bp, Homo sapiens
aaatgctgttcctta

SEQ ID NO: 482717 - DNA, 15 bp, Homo sapiens
aatgctgttccttat

SEQ ID NO: 482718 - DNA, 15 bp, Homo sapiens
atgctgttccttatt

SEQ ID NO: 482719 - DNA, 15 bp, Homo sapiens
tgctgttccttattt

SEQ ID NO: 482720 - DNA, 15 bp, Homo sapiens
gctgttccttatttt

SEQ ID NO: 482721 - DNA, 15 bp, Homo sapiens
ctgttccttattttt

SEQ ID NO: 482722 - DNA, 15 bp, Homo sapiens
tgttccttatttttg

SEQ ID NO: 482723 - DNA, 15 bp, Homo sapiens
gttccttatttttgt

SEQ ID NO: 482724 - DNA, 15 bp, Homo sapiens
ttccttatttttgtt

SEQ ID NO: 482725 - DNA, 15 bp, Homo sapiens
tccttatttttgttt

SEQ ID NO: 482726 - DNA, 15 bp, Homo sapiens
ccttatttttgtttt

SEQ ID NO: 482727 - DNA, 15 bp, Homo sapiens
cttatttttgttttt

SEQ ID NO: 482728 - DNA, 15 bp, Homo sapiens
tatttttgttttttc

SEQ ID NO: 482729 - DNA, 15 bp, Homo sapiens
atttttgttttttct

SEQ ID NO: 482730 - DNA, 15 bp, Homo sapiens
tttttgttttttctg

SEQ ID NO: 482731 - DNA, 15 bp, Homo sapiens
ttttgttttttctgc

SEQ ID NO: 482732 - DNA, 15 bp, Homo sapiens
tttgttttttctgct

SEQ ID NO: 482733 - DNA, 15 bp, Homo sapiens
ttgttttttctgctg

SEQ ID NO: 482734 - DNA, 15 bp, Homo sapiens
tgttttttctgctga

SEQ ID NO: 482735 - DNA, 15 bp, Homo sapiens
gttttttctgctgag

SEQ ID NO: 482736 - DNA, 15 bp, Homo sapiens
ttttttctgctgagt

SEQ ID NO: 482737 - DNA, 15 bp, Homo sapiens
tttttctgctgagta

SEQ ID NO: 482738 - DNA, 15 bp, Homo sapiens
ttttctgctgagtaa

SEQ ID NO: 482739 - DNA, 15 bp, Homo sapiens
tttctgctgagtaag

SEQ ID NO: 482740 - DNA, 15 bp, Homo sapiens
ttctgctgagtaaga

SEQ ID NO: 482741 - DNA, 15 bp, Homo sapiens
tctgctgagtaagat

SEQ ID NO: 482742 - DNA, 15 bp, Homo sapiens
ctgctgagtaagata

SEQ ID NO: 482743 - DNA, 15 bp, Homo sapiens
tgctgagtaagatat

SEQ ID NO: 482744 - DNA, 15 bp, Homo sapiens
gctgagtaagatatc

SEQ ID NO: 482745 - DNA, 15 bp, Homo sapiens
ctgagtaagatatcc

SEQ ID NO: 482746 - DNA, 15 bp, Homo sapiens
tgagtaagatatccc

SEQ ID NO: 482747 - DNA, 15 bp, Homo sapiens
gagtaagatatccct

SEQ ID NO: 482748 - DNA, 15 bp, Homo sapiens
agtaagatatccctt

SEQ ID NO: 482749 - DNA, 15 bp, Homo sapiens
gtaagatatcccttc

SEQ ID NO: 482750 - DNA, 15 bp, Homo sapiens
taagatatcccttct

SEQ ID NO: 482751 - DNA, 15 bp, Homo sapiens
aagatatcccttctg

SEQ ID NO: 482752 - DNA, 15 bp, Homo sapiens
agatatcccttctga

SEQ ID NO: 482753 - DNA, 15 bp, Homo sapiens
gatatcccttctgaa

SEQ ID NO: 482754 - DNA, 15 bp, Homo sapiens
atatcccttctgaag

SEQ ID NO: 482755 - DNA, 15 bp, Homo sapiens
tatcccttctgaagt

SEQ ID NO: 482756 - DNA, 15 bp, Homo sapiens
atcccttctgaagtt

SEQ ID NO: 482757 - DNA, 15 bp, Homo sapiens
tcccttctgaagttt

SEQ ID NO: 482758 - DNA, 15 bp, Homo sapiens
cccttctgaagttta

SEQ ID NO: 482759 - DNA, 15 bp, Homo sapiens
ccttctgaagtttat

SEQ ID NO: 482760 - DNA, 15 bp, Homo sapiens
cttctgaagtttatg

SEQ ID NO: 482761 - DNA, 15 bp, Homo sapiens
ttctgaagtttatga

SEQ ID NO: 482762 - DNA, 15 bp, Homo sapiens
tctgaagtttatgag

SEQ ID NO: 482763 - DNA, 15 bp, Homo sapiens
ctgaagtttatgaga

SEQ ID NO: 482764 - DNA, 15 bp, Homo sapiens
tgaagtttatgagat

SEQ ID NO: 482765 - DNA, 15 bp, Homo sapiens
gaagtttatgagata

SEQ ID NO: 482766 - DNA, 15 bp, Homo sapiens
aagtttatgagatag

SEQ ID NO: 482767 - DNA, 15 bp, Homo sapiens
agtttatgagataga

SEQ ID NO: 482768 - DNA, 15 bp, Homo sapiens
gtttatgagatagag

SEQ ID NO: 482769 - DNA, 15 bp, Homo sapiens
tttatgagatagagc

SEQ ID NO: 482770 - DNA, 15 bp, Homo sapiens
ttatgagatagagct

SEQ ID NO: 482771 - DNA, 15 bp, Homo sapiens
tatgagatagagctg

SEQ ID NO: 482772 - DNA, 15 bp, Homo sapiens
atgagatagagctgt

SEQ ID NO: 482773 - DNA, 15 bp, Homo sapiens
tgagatagagctgtt

SEQ ID NO: 482774 - DNA, 15 bp, Homo sapiens
gagatagagctgtta

SEQ ID NO: 482775 - DNA, 15 bp, Homo sapiens
agatagagctgttag

SEQ ID NO: 482776 - DNA, 15 bp, Homo sapiens
gatagagctgttaga

SEQ ID NO: 482777 - DNA, 15 bp, Homo sapiens
atagagctgttagat

SEQ ID NO: 482778 - DNA, 15 bp, Homo sapiens
tagagctgttagatg

SEQ ID NO: 482779 - DNA, 15 bp, Homo sapiens
agagctgttagatga

SEQ ID NO: 482780 - DNA, 15 bp, Homo sapiens
gagctgttagatgaa

SEQ ID NO: 482781 - DNA, 15 bp, Homo sapiens
agctgttagatgaaa

SEQ ID NO: 482782 - DNA, 15 bp, Homo sapiens
gctgttagatgaaag

SEQ ID NO: 482783 - DNA, 15 bp, Homo sapiens
ctgttagatgaaaga

SEQ ID NO: 482784 - DNA, 15 bp, Homo sapiens
tgttagatgaaagag

SEQ ID NO: 482785 - DNA, 15 bp, Homo sapiens
gttagatgaaagaga

SEQ ID NO: 482786 - DNA, 15 bp, Homo sapiens
ttagatgaaagagaa

SEQ ID NO: 482787 - DNA, 15 bp, Homo sapiens
tagatgaaagagaag

SEQ ID NO: 482788 - DNA, 15 bp, Homo sapiens
agatgaaagagaagc

SEQ ID NO: 482789 - DNA, 15 bp, Homo sapiens
gatgaaagagaagcc

SEQ ID NO: 482790 - DNA, 15 bp, Homo sapiens
atgaaagagaagcct

SEQ ID NO: 482791 - DNA, 15 bp, Homo sapiens
tgaaagagaagcctg

SEQ ID NO: 482792 - DNA, 15 bp, Homo sapiens
gaaagagaagcctga

SEQ ID NO: 482793 - DNA, 15 bp, Homo sapiens
aaagagaagcctgaa

SEQ ID NO: 482794 - DNA, 15 bp, Homo sapiens
aagagaagcctgaaa

SEQ ID NO: 482795 - DNA, 15 bp, Homo sapiens
agagaagcctgaaat

SEQ ID NO: 482796 - DNA, 15 bp, Homo sapiens
gagaagcctgaaatg

SEQ ID NO: 482797 - DNA, 15 bp, Homo sapiens
agaagcctgaaatgt

SEQ ID NO: 482798 - DNA, 15 bp, Homo sapiens
gaagcctgaaatgtt

SEQ ID NO: 482799 - DNA, 15 bp, Homo sapiens
aagcctgaaatgttg

SEQ ID NO: 482800 - DNA, 15 bp, Homo sapiens
agcctgaaatgttga

SEQ ID NO: 482801 - DNA, 15 bp, Homo sapiens
gcctgaaatgttgac

SEQ ID NO: 482802 - DNA, 15 bp, Homo sapiens
cctgaaatgttgact

SEQ ID NO: 482803 - DNA, 15 bp, Homo sapiens
ctgaaatgttgactc

SEQ ID NO: 482804 - DNA, 15 bp, Homo sapiens
tgaaatgttgactca

SEQ ID NO: 482805 - DNA, 15 bp, Homo sapiens
gaaatgttgactcat

SEQ ID NO: 482806 - DNA, 15 bp, Homo sapiens
aaatgttgactcatg

SEQ ID NO: 482807 - DNA, 15 bp, Homo sapiens
aatgttgactcatgt

SEQ ID NO: 482808 - DNA, 15 bp, Homo sapiens
atgttgactcatgta

SEQ ID NO: 482809 - DNA, 15 bp, Homo sapiens
tgttgactcatgtaa

SEQ ID NO: 482810 - DNA, 15 bp, Homo sapiens
gttgactcatgtaat

SEQ ID NO: 482811 - DNA, 15 bp, Homo sapiens
ttgactcatgtaata

SEQ ID NO: 482812 - DNA, 15 bp, Homo sapiens
tgactcatgtaatat

SEQ ID NO: 482813 - DNA, 15 bp, Homo sapiens
gactcatgtaatatc

SEQ ID NO: 482814 - DNA, 15 bp, Homo sapiens
actcatgtaatatcc

SEQ ID NO: 482815 - DNA, 15 bp, Homo sapiens
ctcatgtaatatcca

SEQ ID NO: 482816 - DNA, 15 bp, Homo sapiens
tcatgtaatatccat

SEQ ID NO: 482817 - DNA, 15 bp, Homo sapiens
catgtaatatccatg

SEQ ID NO: 482818 - DNA, 15 bp, Homo sapiens
atgtaatatccatgc

SEQ ID NO: 482819 - DNA, 15 bp, Homo sapiens
tgtaatatccatgct

SEQ ID NO: 482820 - DNA, 15 bp, Homo sapiens
gtaatatccatgctc

SEQ ID NO: 482821 - DNA, 15 bp, Homo sapiens
taatatccatgctct

SEQ ID NO: 482822 - DNA, 15 bp, Homo sapiens
aatatccatgctctg

SEQ ID NO: 482823 - DNA, 15 bp, Homo sapiens
atatccatgctctgc

SEQ ID NO: 482824 - DNA, 15 bp, Homo sapiens
tatccatgctctgct

SEQ ID NO: 482825 - DNA, 15 bp, Homo sapiens
atccatgctctgcta

SEQ ID NO: 482826 - DNA, 15 bp, Homo sapiens
tccatgctctgctag

SEQ ID NO: 482827 - DNA, 15 bp, Homo sapiens
ccatgctctgctaga

SEQ ID NO: 482828 - DNA, 15 bp, Homo sapiens
catgctctgctagat

SEQ ID NO: 482829 - DNA, 15 bp, Homo sapiens
atgctctgctagatg

SEQ ID NO: 482830 - DNA, 15 bp, Homo sapiens
tgctctgctagatga

SEQ ID NO: 482831 - DNA, 15 bp, Homo sapiens
gctctgctagatgaa

SEQ ID NO: 482832 - DNA, 15 bp, Homo sapiens
ctctgctagatgaac

SEQ ID NO: 482833 - DNA, 15 bp, Homo sapiens
tctgctagatgaact

SEQ ID NO: 482834 - DNA, 15 bp, Homo sapiens
ctgctagatgaactt

SEQ ID NO: 482835 - DNA, 15 bp, Homo sapiens
tgctagatgaacttc

SEQ ID NO: 482836 - DNA, 15 bp, Homo sapiens
gctagatgaacttct

SEQ ID NO: 482837 - DNA, 15 bp, Homo sapiens
ctagatgaacttctt

SEQ ID NO: 482838 - DNA, 15 bp, Homo sapiens
tagatgaacttcttc

SEQ ID NO: 482839 - DNA, 15 bp, Homo sapiens
agatgaacttcttcc

SEQ ID NO: 482840 - DNA, 15 bp, Homo sapiens
gatgaacttcttcct

SEQ ID NO: 482841 - DNA, 15 bp, Homo sapiens
atgaacttcttccta

SEQ ID NO: 482842 - DNA, 15 bp, Homo sapiens
tgaacttcttcctag

SEQ ID NO: 482843 - DNA, 15 bp, Homo sapiens
gaacttcttcctaga

SEQ ID NO: 482844 - DNA, 15 bp, Homo sapiens
aacttcttcctagag

SEQ ID NO: 482845 - DNA, 15 bp, Homo sapiens
acttcttcctagagt

SEQ ID NO: 482846 - DNA, 15 bp, Homo sapiens
cttcttcctagagtt

SEQ ID NO: 482847 - DNA, 15 bp, Homo sapiens
ttcttcctagagttt

SEQ ID NO: 482848 - DNA, 15 bp, Homo sapiens
tcttcctagagtttt

SEQ ID NO: 482849 - DNA, 15 bp, Homo sapiens
cttcctagagtttta

SEQ ID NO: 482850 - DNA, 15 bp, Homo sapiens
ttcctagagttttaa

SEQ ID NO: 482851 - DNA, 15 bp, Homo sapiens
tcctagagttttaaa

SEQ ID NO: 482852 - DNA, 15 bp, Homo sapiens
cctagagttttaaaa

SEQ ID NO: 482853 - DNA, 15 bp, Homo sapiens
ctagagttttaaaag

SEQ ID NO: 482854 - DNA, 15 bp, Homo sapiens
tagagttttaaaagg

SEQ ID NO: 482855 - DNA, 15 bp, Homo sapiens
agagttttaaaaggg

SEQ ID NO: 482856 - DNA, 15 bp, Homo sapiens
gagttttaaaaggga

SEQ ID NO: 482857 - DNA, 15 bp, Homo sapiens
agttttaaaagggag

SEQ ID NO: 482858 - DNA, 15 bp, Homo sapiens
gttttaaaagggagg

SEQ ID NO: 482859 - DNA, 15 bp, Homo sapiens
ttttaaaagggaggt

SEQ ID NO: 482860 - DNA, 15 bp, Homo sapiens
tttaaaagggaggtc

SEQ ID NO: 482861 - DNA, 15 bp, Homo sapiens
ttaaaagggaggtca

SEQ ID NO: 482862 - DNA, 15 bp, Homo sapiens
taaaagggaggtcat

SEQ ID NO: 482863 - DNA, 15 bp, Homo sapiens
aaaagggaggtcatg

SEQ ID NO: 482864 - DNA, 15 bp, Homo sapiens
aaagggaggtcatgg

SEQ ID NO: 482865 - DNA, 15 bp, Homo sapiens
aagggaggtcatgga

SEQ ID NO: 482866 - DNA, 15 bp, Homo sapiens
agggaggtcatggag

SEQ ID NO: 482867 - DNA, 15 bp, Homo sapiens
gggaggtcatggaga

SEQ ID NO: 482868 - DNA, 15 bp, Homo sapiens
ggaggtcatggagac

SEQ ID NO: 482869 - DNA, 15 bp, Homo sapiens
gaggtcatggagaca

SEQ ID NO: 482870 - DNA, 15 bp, Homo sapiens
aggtcatggagacac

SEQ ID NO: 482871 - DNA, 15 bp, Homo sapiens
ggtcatggagacact

SEQ ID NO: 482872 - DNA, 15 bp, Homo sapiens
gtcatggagacactg

SEQ ID NO: 482873 - DNA, 15 bp, Homo sapiens
tcatggagacactga

SEQ ID NO: 482874 - DNA, 15 bp, Homo sapiens
catggagacactgag

SEQ ID NO: 482875 - DNA, 15 bp, Homo sapiens
atggagacactgagc

SEQ ID NO: 482876 - DNA, 15 bp, Homo sapiens
tggagacactgagct

SEQ ID NO: 482877 - DNA, 15 bp, Homo sapiens
ggagacactgagctc

SEQ ID NO: 482878 - DNA, 15 bp, Homo sapiens
gagacactgagctct

SEQ ID NO: 482879 - DNA, 15 bp, Homo sapiens
agacactgagctcta

SEQ ID NO: 482880 - DNA, 15 bp, Homo sapiens
gacactgagctctaa

SEQ ID NO: 482881 - DNA, 15 bp, Homo sapiens
acactgagctctaag

SEQ ID NO: 482882 - DNA, 15 bp, Homo sapiens
cactgagctctaaga

SEQ ID NO: 482883 - DNA, 15 bp, Homo sapiens
actgagctctaagac

SEQ ID NO: 482884 - DNA, 15 bp, Homo sapiens
ctgagctctaagaca

SEQ ID NO: 482885 - DNA, 15 bp, Homo sapiens
tgagctctaagacaa

SEQ ID NO: 482886 - DNA, 15 bp, Homo sapiens
gagctctaagacaaa

SEQ ID NO: 482887 - DNA, 15 bp, Homo sapiens
agctctaagacaaac

SEQ ID NO: 482888 - DNA, 15 bp, Homo sapiens
gctctaagacaaact

SEQ ID NO: 482889 - DNA, 15 bp, Homo sapiens
ctctaagacaaactt

SEQ ID NO: 482890 - DNA, 15 bp, Homo sapiens
tctaagacaaacttg

SEQ ID NO: 482891 - DNA, 15 bp, Homo sapiens
ctaagacaaacttgg

SEQ ID NO: 482892 - DNA, 15 bp, Homo sapiens
taagacaaacttggc

SEQ ID NO: 482893 - DNA, 15 bp, Homo sapiens
aagacaaacttggcc

SEQ ID NO: 482894 - DNA, 15 bp, Homo sapiens
agacaaacttggccc

SEQ ID NO: 482895 - DNA, 15 bp, Homo sapiens
gacaaacttggccca

SEQ ID NO: 482896 - DNA, 15 bp, Homo sapiens
acaaacttggcccag

SEQ ID NO: 482897 - DNA, 15 bp, Homo sapiens
caaacttggcccagc

SEQ ID NO: 482898 - DNA, 15 bp, Homo sapiens
aaacttggcccagcc

SEQ ID NO: 482899 - DNA, 15 bp, Homo sapiens
aacttggcccagcca

SEQ ID NO: 482900 - DNA, 15 bp, Homo sapiens
acttggcccagccac

SEQ ID NO: 482901 - DNA, 15 bp, Homo sapiens
cttggcccagccact

SEQ ID NO: 482902 - DNA, 15 bp, Homo sapiens
ttggcccagccacta

SEQ ID NO: 482903 - DNA, 15 bp, Homo sapiens
tggcccagccactat

SEQ ID NO: 482904 - DNA, 15 bp, Homo sapiens
ggcccagccactatc

SEQ ID NO: 482905 - DNA, 15 bp, Homo sapiens
gcccagccactatcc

SEQ ID NO: 482906 - DNA, 15 bp, Homo sapiens
cccagccactatcct

SEQ ID NO: 482907 - DNA, 15 bp, Homo sapiens
ccagccactatcctg

SEQ ID NO: 482908 - DNA, 15 bp, Homo sapiens
cagccactatcctgt

SEQ ID NO: 482909 - DNA, 15 bp, Homo sapiens
agccactatcctgtc

SEQ ID NO: 482910 - DNA, 15 bp, Homo sapiens
gccactatcctgtcc

SEQ ID NO: 482911 - DNA, 15 bp, Homo sapiens
ccactatcctgtcca

SEQ ID NO: 482912 - DNA, 15 bp, Homo sapiens
cactatcctgtccat

SEQ ID NO: 482913 - DNA, 15 bp, Homo sapiens
actatcctgtccatc

SEQ ID NO: 482914 - DNA, 15 bp, Homo sapiens
ctatcctgtccatca

SEQ ID NO: 482915 - DNA, 15 bp, Homo sapiens
tatcctgtccatcat

SEQ ID NO: 482916 - DNA, 15 bp, Homo sapiens
atcctgtccatcatt

SEQ ID NO: 482917 - DNA, 15 bp, Homo sapiens
tcctgtccatcatta

SEQ ID NO: 482918 - DNA, 15 bp, Homo sapiens
cctgtccatcattat

SEQ ID NO: 482919 - DNA, 15 bp, Homo sapiens
ctgtccatcattatt

SEQ ID NO: 482920 - DNA, 15 bp, Homo sapiens
tgtccatcattattt

SEQ ID NO: 482921 - DNA, 15 bp, Homo sapiens
gtccatcattatttc

SEQ ID NO: 482922 - DNA, 15 bp, Homo sapiens
tccatcattatttct

SEQ ID NO: 482923 - DNA, 15 bp, Homo sapiens
ccatcattatttcta

SEQ ID NO: 482924 - DNA, 15 bp, Homo sapiens
catcattatttctac

SEQ ID NO: 482925 - DNA, 15 bp, Homo sapiens
atcattatttctact

SEQ ID NO: 482926 - DNA, 15 bp, Homo sapiens
tcattatttctactt

SEQ ID NO: 482927 - DNA, 15 bp, Homo sapiens
cattatttctacttc

SEQ ID NO: 482928 - DNA, 15 bp, Homo sapiens
attatttctacttcc

SEQ ID NO: 482929 - DNA, 15 bp, Homo sapiens
ttatttctacttcct

SEQ ID NO: 482930 - DNA, 15 bp, Homo sapiens
tatttctacttcctt

SEQ ID NO: 482931 - DNA, 15 bp, Homo sapiens
atttctacttccttt

SEQ ID NO: 482932 - DNA, 15 bp, Homo sapiens
tttctacttccttta

SEQ ID NO: 482933 - DNA, 15 bp, Homo sapiens
ttctacttcctttat

SEQ ID NO: 482934 - DNA, 15 bp, Homo sapiens
tctacttcctttatg

SEQ ID NO: 482935 - DNA, 15 bp, Homo sapiens
ctacttcctttatgt

SEQ ID NO: 482936 - DNA, 15 bp, Homo sapiens
tacttcctttatgtc

SEQ ID NO: 482937 - DNA, 15 bp, Homo sapiens
acttcctttatgtcc

SEQ ID NO: 482938 - DNA, 15 bp, Homo sapiens
cttcctttatgtcca

SEQ ID NO: 482939 - DNA, 15 bp, Homo sapiens
ttcctttatgtccaa

SEQ ID NO: 482940 - DNA, 15 bp, Homo sapiens
tcctttatgtccaaa

SEQ ID NO: 482941 - DNA, 15 bp, Homo sapiens
cctttatgtccaaaa

SEQ ID NO: 482942 - DNA, 15 bp, Homo sapiens
ctttatgtccaaaaa

SEQ ID NO: 482943 - DNA, 15 bp, Homo sapiens
tttatgtccaaaaac

SEQ ID NO: 482944 - DNA, 15 bp, Homo sapiens
ttatgtccaaaaaca

SEQ ID NO: 482945 - DNA, 15 bp, Homo sapiens
tatgtccaaaaacat

SEQ ID NO: 482946 - DNA, 15 bp, Homo sapiens
atgtccaaaaacatc

SEQ ID NO: 482947 - DNA, 15 bp, Homo sapiens
tgtccaaaaacatca

SEQ ID NO: 482948 - DNA, 15 bp, Homo sapiens
gtccaaaaacatcac

SEQ ID NO: 482949 - DNA, 15 bp, Homo sapiens
tccaaaaacatcacc

SEQ ID NO: 482950 - DNA, 15 bp, Homo sapiens
ccaaaaacatcacca

SEQ ID NO: 482951 - DNA, 15 bp, Homo sapiens
caaaaacatcaccat

SEQ ID NO: 482952 - DNA, 15 bp, Homo sapiens
aaaaacatcaccatc

SEQ ID NO: 482953 - DNA, 15 bp, Homo sapiens
aaaacatcaccatcc

SEQ ID NO: 482954 - DNA, 15 bp, Homo sapiens
aaacatcaccatcca

SEQ ID NO: 482955 - DNA, 15 bp, Homo sapiens
aacatcaccatccag

SEQ ID NO: 482956 - DNA, 15 bp, Homo sapiens
acatcaccatccaga

SEQ ID NO: 482957 - DNA, 15 bp, Homo sapiens
catcaccatccagat

SEQ ID NO: 482958 - DNA, 15 bp, Homo sapiens
atcaccatccagatg

SEQ ID NO: 482959 - DNA, 15 bp, Homo sapiens
tcaccatccagatgt

SEQ ID NO: 482960 - DNA, 15 bp, Homo sapiens
caccatccagatgtg

SEQ ID NO: 482961 - DNA, 15 bp, Homo sapiens
accatccagatgtga

SEQ ID NO: 482962 - DNA, 15 bp, Homo sapiens
ccatccagatgtgag

SEQ ID NO: 482963 - DNA, 15 bp, Homo sapiens
catccagatgtgagc

SEQ ID NO: 482964 - DNA, 15 bp, Homo sapiens
atccagatgtgagcc

SEQ ID NO: 482965 - DNA, 15 bp, Homo sapiens
tccagatgtgagcct

SEQ ID NO: 482966 - DNA, 15 bp, Homo sapiens
ccagatgtgagcctc

SEQ ID NO: 482967 - DNA, 15 bp, Homo sapiens
cagatgtgagcctct

SEQ ID NO: 482968 - DNA, 15 bp, Homo sapiens
agatgtgagcctctg

SEQ ID NO: 482969 - DNA, 15 bp, Homo sapiens
gatgtgagcctctgg

SEQ ID NO: 482970 - DNA, 15 bp, Homo sapiens
atgtgagcctctggg

SEQ ID NO: 482971 - DNA, 15 bp, Homo sapiens
tgtgagcctctgggt

SEQ ID NO: 482972 - DNA, 15 bp, Homo sapiens
gtgagcctctgggtc

SEQ ID NO: 482973 - DNA, 15 bp, Homo sapiens
tgagcctctgggtct

SEQ ID NO: 482974 - DNA, 15 bp, Homo sapiens
gagcctctgggtctg

SEQ ID NO: 482975 - DNA, 15 bp, Homo sapiens
agcctctgggtctgt

SEQ ID NO: 482976 - DNA, 15 bp, Homo sapiens
gcctctgggtctgtt

SEQ ID NO: 482977 - DNA, 15 bp, Homo sapiens
cctctgggtctgttt

SEQ ID NO: 482978 - DNA, 15 bp, Homo sapiens
ctctgggtctgtttc

SEQ ID NO: 482979 - DNA, 15 bp, Homo sapiens
tctgggtctgtttcc

SEQ ID NO: 482980 - DNA, 15 bp, Homo sapiens
ctgggtctgtttcct

SEQ ID NO: 482981 - DNA, 15 bp, Homo sapiens
tgggtctgtttcctt

SEQ ID NO: 482982 - DNA, 15 bp, Homo sapiens
gggtctgtttccttt

SEQ ID NO: 482983 - DNA, 15 bp, Homo sapiens
ggtctgtttcctttg

SEQ ID NO: 482984 - DNA, 15 bp, Homo sapiens
gtctgtttcctttgt

SEQ ID NO: 482985 - DNA, 15 bp, Homo sapiens
tctgtttcctttgtc

SEQ ID NO: 482986 - DNA, 15 bp, Homo sapiens
ctgtttcctttgtct

SEQ ID NO: 482987 - DNA, 15 bp, Homo sapiens
tgtttcctttgtctt

SEQ ID NO: 482988 - DNA, 15 bp, Homo sapiens
gtttcctttgtcttg

SEQ ID NO: 482989 - DNA, 15 bp, Homo sapiens
tttcctttgtcttgc

SEQ ID NO: 482990 - DNA, 15 bp, Homo sapiens
ttcctttgtcttgct

SEQ ID NO: 482991 - DNA, 15 bp, Homo sapiens
tcctttgtcttgcta

SEQ ID NO: 482992 - DNA, 15 bp, Homo sapiens
cctttgtcttgctag

SEQ ID NO: 482993 - DNA, 15 bp, Homo sapiens
ctttgtcttgctagg

SEQ ID NO: 482994 - DNA, 15 bp, Homo sapiens
tttgtcttgctaggg

SEQ ID NO: 482995 - DNA, 15 bp, Homo sapiens
ttgtcttgctaggga

SEQ ID NO: 482996 - DNA, 15 bp, Homo sapiens
tgtcttgctagggaa

SEQ ID NO: 482997 - DNA, 15 bp, Homo sapiens
gtcttgctagggaag

SEQ ID NO: 482998 - DNA, 15 bp, Homo sapiens
tcttgctagggaaga

SEQ ID NO: 482999 - DNA, 15 bp, Homo sapiens
cttgctagggaagac

SEQ ID NO: 483000 - DNA, 15 bp, Homo sapiens
ttgctagggaagacg

SEQ ID NO: 483001 - DNA, 15 bp, Homo sapiens
tgctagggaagacga

SEQ ID NO: 483002 - DNA, 15 bp, Homo sapiens
gctagggaagacgag

SEQ ID NO: 483003 - DNA, 15 bp, Homo sapiens
ctagggaagacgagc

SEQ ID NO: 483004 - DNA, 15 bp, Homo sapiens
tagggaagacgagca

SEQ ID NO: 483005 - DNA, 15 bp, Homo sapiens
agggaagacgagcac

SEQ ID NO: 483006 - DNA, 15 bp, Homo sapiens
gggaagacgagcacg

SEQ ID NO: 483007 - DNA, 15 bp, Homo sapiens
ggaagacgagcacgc

SEQ ID NO: 483008 - DNA, 15 bp, Homo sapiens
gaagacgagcacgcc

SEQ ID NO: 483009 - DNA, 15 bp, Homo sapiens
aagacgagcacgccc

SEQ ID NO: 483010 - DNA, 15 bp, Homo sapiens
agacgagcacgccct

SEQ ID NO: 483011 - DNA, 15 bp, Homo sapiens
gacgagcacgccctc

SEQ ID NO: 483012 - DNA, 15 bp, Homo sapiens
acgagcacgccctca

SEQ ID NO: 483013 - DNA, 15 bp, Homo sapiens
cgagcacgccctcat

SEQ ID NO: 483014 - DNA, 15 bp, Homo sapiens
gagcacgccctcatc

SEQ ID NO: 483015 - DNA, 15 bp, Homo sapiens
agcacgccctcatcc

SEQ ID NO: 483016 - DNA, 15 bp, Homo sapiens
gcacgccctcatcca

SEQ ID NO: 483017 - DNA, 15 bp, Homo sapiens
cacgccctcatccag

SEQ ID NO: 483018 - DNA, 15 bp, Homo sapiens
acgccctcatccagc

SEQ ID NO: 483019 - DNA, 15 bp, Homo sapiens
cgccctcatccagca

SEQ ID NO: 483020 - DNA, 15 bp, Homo sapiens
gccctcatccagcag

SEQ ID NO: 483021 - DNA, 15 bp, Homo sapiens
ccctcatccagcagt

SEQ ID NO: 483022 - DNA, 15 bp, Homo sapiens
cctcatccagcagta

SEQ ID NO: 483023 - DNA, 15 bp, Homo sapiens
ctcatccagcagtat

SEQ ID NO: 483024 - DNA, 15 bp, Homo sapiens
tcatccagcagtatt

SEQ ID NO: 483025 - DNA, 15 bp, Homo sapiens
catccagcagtattg

SEQ ID NO: 483026 - DNA, 15 bp, Homo sapiens
atccagcagtattgc

SEQ ID NO: 483027 - DNA, 15 bp, Homo sapiens
tccagcagtattgcc

SEQ ID NO: 483028 - DNA, 15 bp, Homo sapiens
ccagcagtattgcca

SEQ ID NO: 483029 - DNA, 15 bp, Homo sapiens
cagcagtattgccaa

SEQ ID NO: 483030 - DNA, 15 bp, Homo sapiens
agcagtattgccaaa

SEQ ID NO: 483031 - DNA, 15 bp, Homo sapiens
gcagtattgccaaac

SEQ ID NO: 483032 - DNA, 15 bp, Homo sapiens
cagtattgccaaaca

SEQ ID NO: 483033 - DNA, 15 bp, Homo sapiens
agtattgccaaacac

SEQ ID NO: 483034 - DNA, 15 bp, Homo sapiens
gtattgccaaacact

SEQ ID NO: 483035 - DNA, 15 bp, Homo sapiens
tattgccaaacactc

SEQ ID NO: 483036 - DNA, 15 bp, Homo sapiens
attgccaaacactcg

SEQ ID NO: 483037 - DNA, 15 bp, Homo sapiens
ttgccaaacactcgg

SEQ ID NO: 483038 - DNA, 15 bp, Homo sapiens
tgccaaacactcgga

SEQ ID NO: 483039 - DNA, 15 bp, Homo sapiens
gccaaacactcggag

SEQ ID NO: 483040 - DNA, 15 bp, Homo sapiens
ccaaacactcggagg

SEQ ID NO: 483041 - DNA, 15 bp, Homo sapiens
caaacactcggagga

SEQ ID NO: 483042 - DNA, 15 bp, Homo sapiens
aaacactcggaggag

SEQ ID NO: 483043 - DNA, 15 bp, Homo sapiens
aacactcggaggaga

SEQ ID NO: 483044 - DNA, 15 bp, Homo sapiens
acactcggaggagag

SEQ ID NO: 483045 - DNA, 15 bp, Homo sapiens
cactcggaggagagt

SEQ ID NO: 483046 - DNA, 15 bp, Homo sapiens
actcggaggagagtc

SEQ ID NO: 483047 - DNA, 15 bp, Homo sapiens
ctcggaggagagtcc

SEQ ID NO: 483048 - DNA, 15 bp, Homo sapiens
tcggaggagagtccc

SEQ ID NO: 483049 - DNA, 15 bp, Homo sapiens
cggaggagagtcccc

SEQ ID NO: 483050 - DNA, 15 bp, Homo sapiens
ggaggagagtcccca

SEQ ID NO: 483051 - DNA, 15 bp, Homo sapiens
gaggagagtccccag

SEQ ID NO: 483052 - DNA, 15 bp, Homo sapiens
aggagagtccccagt

SEQ ID NO: 483053 - DNA, 15 bp, Homo sapiens
ggagagtccccagtg

SEQ ID NO: 483054 - DNA, 15 bp, Homo sapiens
gagagtccccagtga

SEQ ID NO: 483055 - DNA, 15 bp, Homo sapiens
agagtccccagtgag

SEQ ID NO: 483056 - DNA, 15 bp, Homo sapiens
gagtccccagtgagc

SEQ ID NO: 483057 - DNA, 15 bp, Homo sapiens
agtccccagtgagcc

SEQ ID NO: 483058 - DNA, 15 bp, Homo sapiens
gtccccagtgagcca

SEQ ID NO: 483059 - DNA, 15 bp, Homo sapiens
tccccagtgagccag

SEQ ID NO: 483060 - DNA, 15 bp, Homo sapiens
ccccagtgagccagc

SEQ ID NO: 483061 - DNA, 15 bp, Homo sapiens
cccagtgagccagcc

SEQ ID NO: 483062 - DNA, 15 bp, Homo sapiens
ccagtgagccagccg

SEQ ID NO: 483063 - DNA, 15 bp, Homo sapiens
cagtgagccagccgc

SEQ ID NO: 483064 - DNA, 15 bp, Homo sapiens
agtgagccagccgca

SEQ ID NO: 483065 - DNA, 15 bp, Homo sapiens
gtgagccagccgcag

SEQ ID NO: 483066 - DNA, 15 bp, Homo sapiens
tgagccagccgcaga

SEQ ID NO: 483067 - DNA, 15 bp, Homo sapiens
gagccagccgcagag

SEQ ID NO: 483068 - DNA, 15 bp, Homo sapiens
agccagccgcagagc

SEQ ID NO: 483069 - DNA, 15 bp, Homo sapiens
gccagccgcagagcc

SEQ ID NO: 483070 - DNA, 15 bp, Homo sapiens
ccagccgcagagccc

SEQ ID NO: 483071 - DNA, 15 bp, Homo sapiens
cagccgcagagccca

SEQ ID NO: 483072 - DNA, 15 bp, Homo sapiens
agccgcagagcccag

SEQ ID NO: 483073 - DNA, 15 bp, Homo sapiens
gccgcagagcccagc

SEQ ID NO: 483074 - DNA, 15 bp, Homo sapiens
ccgcagagcccagct

SEQ ID NO: 483075 - DNA, 15 bp, Homo sapiens
cgcagagcccagctc

SEQ ID NO: 483076 - DNA, 15 bp, Homo sapiens
gcagagcccagctca

SEQ ID NO: 483077 - DNA, 15 bp, Homo sapiens
cagagcccagctcag

SEQ ID NO: 483078 - DNA, 15 bp, Homo sapiens
agagcccagctcaga

SEQ ID NO: 483079 - DNA, 15 bp, Homo sapiens
gagcccagctcagat

SEQ ID NO: 483080 - DNA, 15 bp, Homo sapiens
agcccagctcagatc

SEQ ID NO: 483081 - DNA, 15 bp, Homo sapiens
gcccagctcagatcc

SEQ ID NO: 483082 - DNA, 15 bp, Homo sapiens
cccagctcagatcct

SEQ ID NO: 483083 - DNA, 15 bp, Homo sapiens
ccagctcagatcctg

SEQ ID NO: 483084 - DNA, 15 bp, Homo sapiens
cagctcagatcctga

SEQ ID NO: 483085 - DNA, 15 bp, Homo sapiens
agctcagatcctgaa

SEQ ID NO: 483086 - DNA, 15 bp, Homo sapiens
gctcagatcctgaag

SEQ ID NO: 483087 - DNA, 15 bp, Homo sapiens
ctcagatcctgaagt

SEQ ID NO: 483088 - DNA, 15 bp, Homo sapiens
tcagatcctgaagtc

SEQ ID NO: 483089 - DNA, 15 bp, Homo sapiens
cagatcctgaagtca

SEQ ID NO: 483090 - DNA, 15 bp, Homo sapiens
agatcctgaagtcag

SEQ ID NO: 483091 - DNA, 15 bp, Homo sapiens
gatcctgaagtcagt

SEQ ID NO: 483092 - DNA, 15 bp, Homo sapiens
atcctgaagtcagta

SEQ ID NO: 483093 - DNA, 15 bp, Homo sapiens
tcctgaagtcagtag

SEQ ID NO: 483094 - DNA, 15 bp, Homo sapiens
cctgaagtcagtaga

SEQ ID NO: 483095 - DNA, 15 bp, Homo sapiens
ctgaagtcagtagag

SEQ ID NO: 483096 - DNA, 15 bp, Homo sapiens
tgaagtcagtagaga

SEQ ID NO: 483097 - DNA, 15 bp, Homo sapiens
gaagtcagtagagag

SEQ ID NO: 483098 - DNA, 15 bp, Homo sapiens
aagtcagtagagagg

SEQ ID NO: 483099 - DNA, 15 bp, Homo sapiens
agtcagtagagaggg

SEQ ID NO: 483100 - DNA, 15 bp, Homo sapiens
gtcagtagagaggga

SEQ ID NO: 483101 - DNA, 15 bp, Homo sapiens
tcagtagagagggaa

SEQ ID NO: 483102 - DNA, 15 bp, Homo sapiens
cagtagagagggaag

SEQ ID NO: 483103 - DNA, 15 bp, Homo sapiens
agtagagagggaaga

SEQ ID NO: 483104 - DNA, 15 bp, Homo sapiens
gtagagagggaagaa

SEQ ID NO: 483105 - DNA, 15 bp, Homo sapiens
tagagagggaagaac

SEQ ID NO: 483106 - DNA, 15 bp, Homo sapiens
agagagggaagaacg

SEQ ID NO: 483107 - DNA, 15 bp, Homo sapiens
gagagggaagaacgt

SEQ ID NO: 483108 - DNA, 15 bp, Homo sapiens
agagggaagaacgtg

SEQ ID NO: 483109 - DNA, 15 bp, Homo sapiens
gagggaagaacgtgg

SEQ ID NO: 483110 - DNA, 15 bp, Homo sapiens
agggaagaacgtgga

SEQ ID NO: 483111 - DNA, 15 bp, Homo sapiens
gggaagaacgtggag

SEQ ID NO: 483112 - DNA, 15 bp, Homo sapiens
ggaagaacgtggaga

SEQ ID NO: 483113 - DNA, 15 bp, Homo sapiens
gaagaacgtggagaa

SEQ ID NO: 483114 - DNA, 15 bp, Homo sapiens
aagaacgtggagaac

SEQ ID NO: 483115 - DNA, 15 bp, Homo sapiens
agaacgtggagaact

SEQ ID NO: 483116 - DNA, 15 bp, Homo sapiens
gaacgtggagaactg

SEQ ID NO: 483117 - DNA, 15 bp, Homo sapiens
aacgtggagaactgg

SEQ ID NO: 483118 - DNA, 15 bp, Homo sapiens
acgtggagaactgga

SEQ ID NO: 483119 - DNA, 15 bp, Homo sapiens
cgtggagaactggag

SEQ ID NO: 483120 - DNA, 15 bp, Homo sapiens
gtggagaactggaga

SEQ ID NO: 483121 - DNA, 15 bp, Homo sapiens
tggagaactggagag

SEQ ID NO: 483122 - DNA, 15 bp, Homo sapiens
ggagaactggagagg

SEQ ID NO: 483123 - DNA, 15 bp, Homo sapiens
gagaactggagagga

SEQ ID NO: 483124 - DNA, 15 bp, Homo sapiens
agaactggagaggat

SEQ ID NO: 483125 - DNA, 15 bp, Homo sapiens
gaactggagaggatc

SEQ ID NO: 483126 - DNA, 15 bp, Homo sapiens
aactggagaggatca

SEQ ID NO: 483127 - DNA, 15 bp, Homo sapiens
actggagaggatcat

SEQ ID NO: 483128 - DNA, 15 bp, Homo sapiens
ctggagaggatcatt

SEQ ID NO: 483129 - DNA, 15 bp, Homo sapiens
tggagaggatcattg

SEQ ID NO: 483130 - DNA, 15 bp, Homo sapiens
ggagaggatcattgc

SEQ ID NO: 483131 - DNA, 15 bp, Homo sapiens
gagaggatcattgct

SEQ ID NO: 483132 - DNA, 15 bp, Homo sapiens
agaggatcattgctg

SEQ ID NO: 483133 - DNA, 15 bp, Homo sapiens
gaggatcattgctga

SEQ ID NO: 483134 - DNA, 15 bp, Homo sapiens
aggatcattgctgac

SEQ ID NO: 483135 - DNA, 15 bp, Homo sapiens
ggatcattgctgacc

SEQ ID NO: 483136 - DNA, 15 bp, Homo sapiens
gatcattgctgacct

SEQ ID NO: 483137 - DNA, 15 bp, Homo sapiens
atcattgctgacctg

SEQ ID NO: 483138 - DNA, 15 bp, Homo sapiens
tcattgctgacctgg

SEQ ID NO: 483139 - DNA, 15 bp, Homo sapiens
cattgctgacctgga

SEQ ID NO: 483140 - DNA, 15 bp, Homo sapiens
attgctgacctggag

SEQ ID NO: 483141 - DNA, 15 bp, Homo sapiens
ttgctgacctggagg

SEQ ID NO: 483142 - DNA, 15 bp, Homo sapiens
tgctgacctggagga

SEQ ID NO: 483143 - DNA, 15 bp, Homo sapiens
gctgacctggaggaa

SEQ ID NO: 483144 - DNA, 15 bp, Homo sapiens
ctgacctggaggaag

SEQ ID NO: 483145 - DNA, 15 bp, Homo sapiens
tgacctggaggaaga

SEQ ID NO: 483146 - DNA, 15 bp, Homo sapiens
gacctggaggaagaa

SEQ ID NO: 483147 - DNA, 15 bp, Homo sapiens
acctggaggaagaac

SEQ ID NO: 483148 - DNA, 15 bp, Homo sapiens
cctggaggaagaaca

SEQ ID NO: 483149 - DNA, 15 bp, Homo sapiens
ctggaggaagaacaa

SEQ ID NO: 483150 - DNA, 15 bp, Homo sapiens
tggaggaagaacaaa

SEQ ID NO: 483151 - DNA, 15 bp, Homo sapiens
ggaggaagaacaaag

SEQ ID NO: 483152 - DNA, 15 bp, Homo sapiens
gaggaagaacaaagg

SEQ ID NO: 483153 - DNA, 15 bp, Homo sapiens
aggaagaacaaaggt

SEQ ID NO: 483154 - DNA, 15 bp, Homo sapiens
ggaagaacaaaggtg

SEQ ID NO: 483155 - DNA, 15 bp, Homo sapiens
gaagaacaaaggtgt

SEQ ID NO: 483156 - DNA, 15 bp, Homo sapiens
aagaacaaaggtgtg

SEQ ID NO: 483157 - DNA, 15 bp, Homo sapiens
agaacaaaggtgtgc

SEQ ID NO: 483158 - DNA, 15 bp, Homo sapiens
gaacaaaggtgtgct

SEQ ID NO: 483159 - DNA, 15 bp, Homo sapiens
aacaaaggtgtgcta

SEQ ID NO: 483160 - DNA, 15 bp, Homo sapiens
acaaaggtgtgctag

SEQ ID NO: 483161 - DNA, 15 bp, Homo sapiens
caaaggtgtgctagg

SEQ ID NO: 483162 - DNA, 15 bp, Homo sapiens
aaaggtgtgctaggc

SEQ ID NO: 483163 - DNA, 15 bp, Homo sapiens
aaggtgtgctaggcc

SEQ ID NO: 483164 - DNA, 15 bp, Homo sapiens
aggtgtgctaggcct

SEQ ID NO: 483165 - DNA, 15 bp, Homo sapiens
ggtgtgctaggcctg

SEQ ID NO: 483166 - DNA, 15 bp, Homo sapiens
gtgtgctaggcctgg

SEQ ID NO: 483167 - DNA, 15 bp, Homo sapiens
tgtgctaggcctggg

SEQ ID NO: 483168 - DNA, 15 bp, Homo sapiens
gtgctaggcctggga

SEQ ID NO: 483169 - DNA, 15 bp, Homo sapiens
tgctaggcctgggag

SEQ ID NO: 483170 - DNA, 15 bp, Homo sapiens
gctaggcctgggaga

SEQ ID NO: 483171 - DNA, 15 bp, Homo sapiens
ctaggcctgggagaa

SEQ ID NO: 483172 - DNA, 15 bp, Homo sapiens
taggcctgggagaag

SEQ ID NO: 483173 - DNA, 15 bp, Homo sapiens
aggcctgggagaagg

SEQ ID NO: 483174 - DNA, 15 bp, Homo sapiens
ggcctgggagaagga

SEQ ID NO: 483175 - DNA, 15 bp, Homo sapiens
gcctgggagaaggaa

SEQ ID NO: 483176 - DNA, 15 bp, Homo sapiens
cctgggagaaggaaa

SEQ ID NO: 483177 - DNA, 15 bp, Homo sapiens
ctgggagaaggaaat

SEQ ID NO: 483178 - DNA, 15 bp, Homo sapiens
tgggagaaggaaata

SEQ ID NO: 483179 - DNA, 15 bp, Homo sapiens
gggagaaggaaatat

SEQ ID NO: 483180 - DNA, 15 bp, Homo sapiens
ggagaaggaaatatg

SEQ ID NO: 483181 - DNA, 15 bp, Homo sapiens
gagaaggaaatatgt

SEQ ID NO: 483182 - DNA, 15 bp, Homo sapiens
agaaggaaatatgtc

SEQ ID NO: 483183 - DNA, 15 bp, Homo sapiens
gaaggaaatatgtca

SEQ ID NO: 483184 - DNA, 15 bp, Homo sapiens
aaggaaatatgtcat

SEQ ID NO: 483185 - DNA, 15 bp, Homo sapiens
aggaaatatgtcatc

SEQ ID NO: 483186 - DNA, 15 bp, Homo sapiens
ggaaatatgtcatcc

SEQ ID NO: 483187 - DNA, 15 bp, Homo sapiens
gaaatatgtcatcct

SEQ ID NO: 483188 - DNA, 15 bp, Homo sapiens
aaatatgtcatcctt

SEQ ID NO: 483189 - DNA, 15 bp, Homo sapiens
aatatgtcatccttt

SEQ ID NO: 483190 - DNA, 15 bp, Homo sapiens
atatgtcatcctttc

SEQ ID NO: 483191 - DNA, 15 bp, Homo sapiens
tatgtcatcctttct

SEQ ID NO: 483192 - DNA, 15 bp, Homo sapiens
atgtcatcctttctt

SEQ ID NO: 483193 - DNA, 15 bp, Homo sapiens
tgtcatcctttcttt

SEQ ID NO: 483194 - DNA, 15 bp, Homo sapiens
gtcatcctttctttt

SEQ ID NO: 483195 - DNA, 15 bp, Homo sapiens
tcatcctttcttttg

SEQ ID NO: 483196 - DNA, 15 bp, Homo sapiens
catcctttcttttgt

SEQ ID NO: 483197 - DNA, 15 bp, Homo sapiens
atcctttcttttgta

SEQ ID NO: 483198 - DNA, 15 bp, Homo sapiens
tcctttcttttgtat

SEQ ID NO: 483199 - DNA, 15 bp, Homo sapiens
cctttcttttgtatg

SEQ ID NO: 483200 - DNA, 15 bp, Homo sapiens
ctttcttttgtatga

SEQ ID NO: 483201 - DNA, 15 bp, Homo sapiens
tttcttttgtatgaa

SEQ ID NO: 483202 - DNA, 15 bp, Homo sapiens
ttcttttgtatgaat

SEQ ID NO: 483203 - DNA, 15 bp, Homo sapiens
tcttttgtatgaatt

SEQ ID NO: 483204 - DNA, 15 bp, Homo sapiens
cttttgtatgaattt

SEQ ID NO: 483205 - DNA, 15 bp, Homo sapiens
ttttgtatgaatttc

SEQ ID NO: 483206 - DNA, 15 bp, Homo sapiens
tttgtatgaatttca

SEQ ID NO: 483207 - DNA, 15 bp, Homo sapiens
ttgtatgaatttcac

SEQ ID NO: 483208 - DNA, 15 bp, Homo sapiens
tgtatgaatttcact

SEQ ID NO: 483209 - DNA, 15 bp, Homo sapiens
gtatgaatttcactg

SEQ ID NO: 483210 - DNA, 15 bp, Homo sapiens
tatgaatttcactgt

SEQ ID NO: 483211 - DNA, 15 bp, Homo sapiens
atgaatttcactgta

SEQ ID NO: 483212 - DNA, 15 bp, Homo sapiens
tgaatttcactgtag

SEQ ID NO: 483213 - DNA, 15 bp, Homo sapiens
gaatttcactgtagc

SEQ ID NO: 483214 - DNA, 15 bp, Homo sapiens
aatttcactgtagcc

SEQ ID NO: 483215 - DNA, 15 bp, Homo sapiens
atttcactgtagccc

SEQ ID NO: 483216 - DNA, 15 bp, Homo sapiens
tttcactgtagcccc

SEQ ID NO: 483217 - DNA, 15 bp, Homo sapiens
ttcactgtagccccc

SEQ ID NO: 483218 - DNA, 15 bp, Homo sapiens
tcactgtagccccca

SEQ ID NO: 483219 - DNA, 15 bp, Homo sapiens
cactgtagcccccat

SEQ ID NO: 483220 - DNA, 15 bp, Homo sapiens
actgtagcccccatt

SEQ ID NO: 483221 - DNA, 15 bp, Homo sapiens
ctgtagcccccattt

SEQ ID NO: 483222 - DNA, 15 bp, Homo sapiens
tgtagcccccattta

SEQ ID NO: 483223 - DNA, 15 bp, Homo sapiens
gtagcccccatttat

SEQ ID NO: 483224 - DNA, 15 bp, Homo sapiens
tagcccccatttatt

SEQ ID NO: 483225 - DNA, 15 bp, Homo sapiens
agcccccatttattc

SEQ ID NO: 483226 - DNA, 15 bp, Homo sapiens
gcccccatttattct

SEQ ID NO: 483227 - DNA, 15 bp, Homo sapiens
cccccatttattctc

SEQ ID NO: 483228 - DNA, 15 bp, Homo sapiens
ccccatttattctct

SEQ ID NO: 483229 - DNA, 15 bp, Homo sapiens
cccatttattctctt

SEQ ID NO: 483230 - DNA, 15 bp, Homo sapiens
ccatttattctcttt

SEQ ID NO: 483231 - DNA, 15 bp, Homo sapiens
catttattctctttt

SEQ ID NO: 483232 - DNA, 15 bp, Homo sapiens
atttattctcttttt

SEQ ID NO: 483233 - DNA, 15 bp, Homo sapiens
tttattctctttttc

SEQ ID NO: 483234 - DNA, 15 bp, Homo sapiens
ttattctctttttca

SEQ ID NO: 483235 - DNA, 15 bp, Homo sapiens
tattctctttttcaa

SEQ ID NO: 483236 - DNA, 15 bp, Homo sapiens
attctctttttcaag

SEQ ID NO: 483237 - DNA, 15 bp, Homo sapiens
ttctctttttcaaga

SEQ ID NO: 483238 - DNA, 15 bp, Homo sapiens
tctctttttcaagac

SEQ ID NO: 483239 - DNA, 15 bp, Homo sapiens
ctctttttcaagact

SEQ ID NO: 483240 - DNA, 15 bp, Homo sapiens
tctttttcaagacta

SEQ ID NO: 483241 - DNA, 15 bp, Homo sapiens
ctttttcaagactat

SEQ ID NO: 483242 - DNA, 15 bp, Homo sapiens
tttttcaagactatt

SEQ ID NO: 483243 - DNA, 15 bp, Homo sapiens
ttttcaagactattg

SEQ ID NO: 483244 - DNA, 15 bp, Homo sapiens
tttcaagactattgt

SEQ ID NO: 483245 - DNA, 15 bp, Homo sapiens
ttcaagactattgtc

SEQ ID NO: 483246 - DNA, 15 bp, Homo sapiens
tcaagactattgtct

SEQ ID NO: 483247 - DNA, 15 bp, Homo sapiens
caagactattgtcta

SEQ ID NO: 483248 - DNA, 15 bp, Homo sapiens
aagactattgtctaa

SEQ ID NO: 483249 - DNA, 15 bp, Homo sapiens
agactattgtctaag

SEQ ID NO: 483250 - DNA, 15 bp, Homo sapiens
gactattgtctaaga

SEQ ID NO: 483251 - DNA, 15 bp, Homo sapiens
actattgtctaagaa

SEQ ID NO: 483252 - DNA, 15 bp, Homo sapiens
ctattgtctaagaaa

SEQ ID NO: 483253 - DNA, 15 bp, Homo sapiens
tattgtctaagaaat

SEQ ID NO: 483254 - DNA, 15 bp, Homo sapiens
attgtctaagaaatc

SEQ ID NO: 483255 - DNA, 15 bp, Homo sapiens
ttgtctaagaaatct

SEQ ID NO: 483256 - DNA, 15 bp, Homo sapiens
tgtctaagaaatctc

SEQ ID NO: 483257 - DNA, 15 bp, Homo sapiens
gtctaagaaatctca

SEQ ID NO: 483258 - DNA, 15 bp, Homo sapiens
tctaagaaatctcag

SEQ ID NO: 483259 - DNA, 15 bp, Homo sapiens
ctaagaaatctcagt

SEQ ID NO: 483260 - DNA, 15 bp, Homo sapiens
taagaaatctcagtg

SEQ ID NO: 483261 - DNA, 15 bp, Homo sapiens
aagaaatctcagtgg

SEQ ID NO: 483262 - DNA, 15 bp, Homo sapiens
agaaatctcagtgga

SEQ ID NO: 483263 - DNA, 15 bp, Homo sapiens
gaaatctcagtggag

SEQ ID NO: 483264 - DNA, 15 bp, Homo sapiens
aaatctcagtggagt

SEQ ID NO: 483265 - DNA, 15 bp, Homo sapiens
aatctcagtggagtg

SEQ ID NO: 483266 - DNA, 15 bp, Homo sapiens
atctcagtggagtga

SEQ ID NO: 483267 - DNA, 15 bp, Homo sapiens
tctcagtggagtgaa

SEQ ID NO: 483268 - DNA, 15 bp, Homo sapiens
ctcagtggagtgaaa

SEQ ID NO: 483269 - DNA, 15 bp, Homo sapiens
tcagtggagtgaaaa

SEQ ID NO: 483270 - DNA, 15 bp, Homo sapiens
cagtggagtgaaaat

SEQ ID NO: 483271 - DNA, 15 bp, Homo sapiens
agtggagtgaaaatt

SEQ ID NO: 483272 - DNA, 15 bp, Homo sapiens
gtggagtgaaaattt

SEQ ID NO: 483273 - DNA, 15 bp, Homo sapiens
tggagtgaaaatttt

SEQ ID NO: 483274 - DNA, 15 bp, Homo sapiens
ggagtgaaaatttta

SEQ ID NO: 483275 - DNA, 15 bp, Homo sapiens
gagtgaaaattttag

SEQ ID NO: 483276 - DNA, 15 bp, Homo sapiens
agtgaaaattttaga

SEQ ID NO: 483277 - DNA, 15 bp, Homo sapiens
gtgaaaattttagag

SEQ ID NO: 483278 - DNA, 15 bp, Homo sapiens
tgaaaattttagagg

SEQ ID NO: 483279 - DNA, 15 bp, Homo sapiens
gaaaattttagaggc

SEQ ID NO: 483280 - DNA, 15 bp, Homo sapiens
aaaattttagaggct

SEQ ID NO: 483281 - DNA, 15 bp, Homo sapiens
aaattttagaggcta

SEQ ID NO: 483282 - DNA, 15 bp, Homo sapiens
aattttagaggctat

SEQ ID NO: 483283 - DNA, 15 bp, Homo sapiens
attttagaggctatt

SEQ ID NO: 483284 - DNA, 15 bp, Homo sapiens
ttagaggctattaac

SEQ ID NO: 483285 - DNA, 15 bp, Homo sapiens
tagaggctattaaca

SEQ ID NO: 483286 - DNA, 15 bp, Homo sapiens
agaggctattaacaa

SEQ ID NO: 483287 - DNA, 15 bp, Homo sapiens
gaggctattaacaaa

SEQ ID NO: 483288 - DNA, 15 bp, Homo sapiens
aggctattaacaaac

SEQ ID NO: 483289 - DNA, 15 bp, Homo sapiens
ggctattaacaaact

SEQ ID NO: 483290 - DNA, 15 bp, Homo sapiens
gctattaacaaactg

SEQ ID NO: 483291 - DNA, 15 bp, Homo sapiens
ctattaacaaactgg

SEQ ID NO: 483292 - DNA, 15 bp, Homo sapiens
tattaacaaactggg

SEQ ID NO: 483293 - DNA, 15 bp, Homo sapiens
attaacaaactggga

SEQ ID NO: 483294 - DNA, 15 bp, Homo sapiens
ttaacaaactgggat

SEQ ID NO: 483295 - DNA, 15 bp, Homo sapiens
taacaaactgggatg

SEQ ID NO: 483296 - DNA, 15 bp, Homo sapiens
aacaaactgggatgc

SEQ ID NO: 483297 - DNA, 15 bp, Homo sapiens
acaaactgggatgct

SEQ ID NO: 483298 - DNA, 15 bp, Homo sapiens
caaactgggatgctg

SEQ ID NO: 483299 - DNA, 15 bp, Homo sapiens
aaactgggatgctgg

SEQ ID NO: 483300 - DNA, 15 bp, Homo sapiens
aactgggatgctggc

SEQ ID NO: 483301 - DNA, 15 bp, Homo sapiens
actgggatgctggct

SEQ ID NO: 483302 - DNA, 15 bp, Homo sapiens
ctgggatgctggctg

SEQ ID NO: 483303 - DNA, 15 bp, Homo sapiens
tgggatgctggctgc

SEQ ID NO: 483304 - DNA, 15 bp, Homo sapiens
gggatgctggctgca

SEQ ID NO: 483305 - DNA, 15 bp, Homo sapiens
ggatgctggctgcaa

SEQ ID NO: 483306 - DNA, 15 bp, Homo sapiens
gatgctggctgcaat

SEQ ID NO: 483307 - DNA, 15 bp, Homo sapiens
atgctggctgcaata

SEQ ID NO: 483308 - DNA, 15 bp, Homo sapiens
tgctggctgcaatac

SEQ ID NO: 483309 - DNA, 15 bp, Homo sapiens
gctggctgcaataca

SEQ ID NO: 483310 - DNA, 15 bp, Homo sapiens
ctggctgcaatacag

SEQ ID NO: 483311 - DNA, 15 bp, Homo sapiens
tggctgcaatacagc

SEQ ID NO: 483312 - DNA, 15 bp, Homo sapiens
ggctgcaatacagca

SEQ ID NO: 483313 - DNA, 15 bp, Homo sapiens
gctgcaatacagcag

SEQ ID NO: 483314 - DNA, 15 bp, Homo sapiens
ctgcaatacagcagc

SEQ ID NO: 483315 - DNA, 15 bp, Homo sapiens
tgcaatacagcagca

SEQ ID NO: 483316 - DNA, 15 bp, Homo sapiens
gcaatacagcagcat

SEQ ID NO: 483317 - DNA, 15 bp, Homo sapiens
caatacagcagcatt

SEQ ID NO: 483318 - DNA, 15 bp, Homo sapiens
aatacagcagcattt

SEQ ID NO: 483319 - DNA, 15 bp, Homo sapiens
atacagcagcatttg

SEQ ID NO: 483320 - DNA, 15 bp, Homo sapiens
tacagcagcatttgg

SEQ ID NO: 483321 - DNA, 15 bp, Homo sapiens
acagcagcatttggg

SEQ ID NO: 483322 - DNA, 15 bp, Homo sapiens
cagcagcatttgggg

SEQ ID NO: 483323 - DNA, 15 bp, Homo sapiens
agcagcatttggggg

SEQ ID NO: 483324 - DNA, 15 bp, Homo sapiens
gcagcatttgggggt

SEQ ID NO: 483325 - DNA, 15 bp, Homo sapiens
cagcatttgggggtt

SEQ ID NO: 483326 - DNA, 15 bp, Homo sapiens
agcatttgggggttc

SEQ ID NO: 483327 - DNA, 15 bp, Homo sapiens
gcatttgggggttca

SEQ ID NO: 483328 - DNA, 15 bp, Homo sapiens
catttgggggttcat

SEQ ID NO: 483329 - DNA, 15 bp, Homo sapiens
atttgggggttcatt

SEQ ID NO: 483330 - DNA, 15 bp, Homo sapiens
tttgggggttcattg

SEQ ID NO: 483331 - DNA, 15 bp, Homo sapiens
ttgggggttcattga

SEQ ID NO: 483332 - DNA, 15 bp, Homo sapiens
tgggggttcattgat

SEQ ID NO: 483333 - DNA, 15 bp, Homo sapiens
gggggttcattgatg

SEQ ID NO: 483334 - DNA, 15 bp, Homo sapiens
ggggttcattgatga

SEQ ID NO: 483335 - DNA, 15 bp, Homo sapiens
gggttcattgatgat

SEQ ID NO: 483336 - DNA, 15 bp, Homo sapiens
ggttcattgatgatg

SEQ ID NO: 483337 - DNA, 15 bp, Homo sapiens
gttcattgatgatgt

SEQ ID NO: 483338 - DNA, 15 bp, Homo sapiens
ttcattgatgatgtc

SEQ ID NO: 483339 - DNA, 15 bp, Homo sapiens
tcattgatgatgtct

SEQ ID NO: 483340 - DNA, 15 bp, Homo sapiens
cattgatgatgtcta

SEQ ID NO: 483341 - DNA, 15 bp, Homo sapiens
attgatgatgtctac

SEQ ID NO: 483342 - DNA, 15 bp, Homo sapiens
ttgatgatgtctact

SEQ ID NO: 483343 - DNA, 15 bp, Homo sapiens
tgatgatgtctactg

SEQ ID NO: 483344 - DNA, 15 bp, Homo sapiens
gatgatgtctactgg

SEQ ID NO: 483345 - DNA, 15 bp, Homo sapiens
atgatgtctactggg

SEQ ID NO: 483346 - DNA, 15 bp, Homo sapiens
tgatgtctactggga

SEQ ID NO: 483347 - DNA, 15 bp, Homo sapiens
gatgtctactgggac

SEQ ID NO: 483348 - DNA, 15 bp, Homo sapiens
atgtctactgggaca

SEQ ID NO: 483349 - DNA, 15 bp, Homo sapiens
tgtctactgggacac

SEQ ID NO: 483350 - DNA, 15 bp, Homo sapiens
gtctactgggacact

SEQ ID NO: 483351 - DNA, 15 bp, Homo sapiens
tctactgggacactt

SEQ ID NO: 483352 - DNA, 15 bp, Homo sapiens
ctactgggacacttg

SEQ ID NO: 483353 - DNA, 15 bp, Homo sapiens
tactgggacacttgc

SEQ ID NO: 483354 - DNA, 15 bp, Homo sapiens
actgggacacttgct

SEQ ID NO: 483355 - DNA, 15 bp, Homo sapiens
ctgggacacttgctt

SEQ ID NO: 483356 - DNA, 15 bp, Homo sapiens
tgggacacttgctta

SEQ ID NO: 483357 - DNA, 15 bp, Homo sapiens
gggacacttgcttaa

SEQ ID NO: 483358 - DNA, 15 bp, Homo sapiens
ggacacttgcttaaa

SEQ ID NO: 483359 - DNA, 15 bp, Homo sapiens
gacacttgcttaaaa

SEQ ID NO: 483360 - DNA, 15 bp, Homo sapiens
acacttgcttaaaac

SEQ ID NO: 483361 - DNA, 15 bp, Homo sapiens
cacttgcttaaaact

SEQ ID NO: 483362 - DNA, 15 bp, Homo sapiens
acttgcttaaaacta

SEQ ID NO: 483363 - DNA, 15 bp, Homo sapiens
cttgcttaaaactac

SEQ ID NO: 483364 - DNA, 15 bp, Homo sapiens
ttgcttaaaactaca

SEQ ID NO: 483365 - DNA, 15 bp, Homo sapiens
tgcttaaaactacaa

SEQ ID NO: 483366 - DNA, 15 bp, Homo sapiens
gcttaaaactacaat

SEQ ID NO: 483367 - DNA, 15 bp, Homo sapiens
cttaaaactacaatt

SEQ ID NO: 483368 - DNA, 15 bp, Homo sapiens
ttaaaactacaattt

SEQ ID NO: 483369 - DNA, 15 bp, Homo sapiens
taaaactacaatttt

SEQ ID NO: 483370 - DNA, 15 bp, Homo sapiens
aaaactacaatttta

SEQ ID NO: 483371 - DNA, 15 bp, Homo sapiens
aaactacaattttat

SEQ ID NO: 483372 - DNA, 15 bp, Homo sapiens
aactacaattttatt

SEQ ID NO: 483373 - DNA, 15 bp, Homo sapiens
actacaattttattc

SEQ ID NO: 483374 - DNA, 15 bp, Homo sapiens
ctacaattttattcc

SEQ ID NO: 483375 - DNA, 15 bp, Homo sapiens
tacaattttattcct

SEQ ID NO: 483376 - DNA, 15 bp, Homo sapiens
acaattttattcctg

SEQ ID NO: 483377 - DNA, 15 bp, Homo sapiens
caattttattcctgc

SEQ ID NO: 483378 - DNA, 15 bp, Homo sapiens
aattttattcctgca

SEQ ID NO: 483379 - DNA, 15 bp, Homo sapiens
attttattcctgcat

SEQ ID NO: 483380 - DNA, 15 bp, Homo sapiens
ttttattcctgcatg

SEQ ID NO: 483381 - DNA, 15 bp, Homo sapiens
tttattcctgcatgc

SEQ ID NO: 483382 - DNA, 15 bp, Homo sapiens
ttattcctgcatgct

SEQ ID NO: 483383 - DNA, 15 bp, Homo sapiens
tattcctgcatgctc

SEQ ID NO: 483384 - DNA, 15 bp, Homo sapiens
attcctgcatgctca

SEQ ID NO: 483385 - DNA, 15 bp, Homo sapiens
ttcctgcatgctcat

SEQ ID NO: 483386 - DNA, 15 bp, Homo sapiens
tcctgcatgctcatc

SEQ ID NO: 483387 - DNA, 15 bp, Homo sapiens
cctgcatgctcatcc

SEQ ID NO: 483388 - DNA, 15 bp, Homo sapiens
ctgcatgctcatcct

SEQ ID NO: 483389 - DNA, 15 bp, Homo sapiens
tgcatgctcatcctg

SEQ ID NO: 483390 - DNA, 15 bp, Homo sapiens
gcatgctcatcctgc

SEQ ID NO: 483391 - DNA, 15 bp, Homo sapiens
catgctcatcctgct

SEQ ID NO: 483392 - DNA, 15 bp, Homo sapiens
atgctcatcctgcta

SEQ ID NO: 483393 - DNA, 15 bp, Homo sapiens
tgctcatcctgctat

SEQ ID NO: 483394 - DNA, 15 bp, Homo sapiens
gctcatcctgctatt

SEQ ID NO: 483395 - DNA, 15 bp, Homo sapiens
ctcatcctgctatta

SEQ ID NO: 483396 - DNA, 15 bp, Homo sapiens
tcatcctgctattaa

SEQ ID NO: 483397 - DNA, 15 bp, Homo sapiens
catcctgctattaat

SEQ ID NO: 483398 - DNA, 15 bp, Homo sapiens
atcctgctattaata

SEQ ID NO: 483399 - DNA, 15 bp, Homo sapiens
tcctgctattaatac

SEQ ID NO: 483400 - DNA, 15 bp, Homo sapiens
cctgctattaataca

SEQ ID NO: 483401 - DNA, 15 bp, Homo sapiens
ctgctattaatacac

SEQ ID NO: 483402 - DNA, 15 bp, Homo sapiens
tgctattaatacaca

SEQ ID NO: 483403 - DNA, 15 bp, Homo sapiens
gctattaatacacat

SEQ ID NO: 483404 - DNA, 15 bp, Homo sapiens
ctattaatacacatt

SEQ ID NO: 483405 - DNA, 15 bp, Homo sapiens
tattaatacacattt

SEQ ID NO: 483406 - DNA, 15 bp, Homo sapiens
attaatacacatttt

SEQ ID NO: 483407 - DNA, 15 bp, Homo sapiens
ttaatacacattttt

SEQ ID NO: 483408 - DNA, 15 bp, Homo sapiens
taatacacattttta

SEQ ID NO: 483409 - DNA, 15 bp, Homo sapiens
aatacacatttttat

SEQ ID NO: 483410 - DNA, 15 bp, Homo sapiens
atacacatttttata

SEQ ID NO: 483411 - DNA, 15 bp, Homo sapiens
tacacatttttatat

SEQ ID NO: 483412 - DNA, 15 bp, Homo sapiens
acacatttttatata

SEQ ID NO: 483413 - DNA, 15 bp, Homo sapiens
cacatttttatataa

SEQ ID NO: 483414 - DNA, 15 bp, Homo sapiens
acatttttatataag

SEQ ID NO: 483415 - DNA, 15 bp, Homo sapiens
catttttatataaga

SEQ ID NO: 483416 - DNA, 15 bp, Homo sapiens
atttttatataagag

SEQ ID NO: 483417 - DNA, 15 bp, Homo sapiens
tttttatataagagg

SEQ ID NO: 483418 - DNA, 15 bp, Homo sapiens
ttttatataagagga

SEQ ID NO: 483419 - DNA, 15 bp, Homo sapiens
tttatataagaggaa

SEQ ID NO: 483420 - DNA, 15 bp, Homo sapiens
ttatataagaggaac

SEQ ID NO: 483421 - DNA, 15 bp, Homo sapiens
tatataagaggaact

SEQ ID NO: 483422 - DNA, 15 bp, Homo sapiens
atataagaggaacta

SEQ ID NO: 483423 - DNA, 15 bp, Homo sapiens
tataagaggaactag

SEQ ID NO: 483424 - DNA, 15 bp, Homo sapiens
ataagaggaactagc

SEQ ID NO: 483425 - DNA, 15 bp, Homo sapiens
taagaggaactagca

SEQ ID NO: 483426 - DNA, 15 bp, Homo sapiens
aagaggaactagcat

SEQ ID NO: 483427 - DNA, 15 bp, Homo sapiens
agaggaactagcatg

SEQ ID NO: 483428 - DNA, 15 bp, Homo sapiens
gaggaactagcatga

SEQ ID NO: 483429 - DNA, 15 bp, Homo sapiens
aggaactagcatgag

SEQ ID NO: 483430 - DNA, 15 bp, Homo sapiens
ggaactagcatgagc

SEQ ID NO: 483431 - DNA, 15 bp, Homo sapiens
gaactagcatgagct

SEQ ID NO: 483432 - DNA, 15 bp, Homo sapiens
aactagcatgagcta

SEQ ID NO: 483433 - DNA, 15 bp, Homo sapiens
actagcatgagctaa

SEQ ID NO: 483434 - DNA, 15 bp, Homo sapiens
ctagcatgagctaaa

SEQ ID NO: 483435 - DNA, 15 bp, Homo sapiens
tagcatgagctaaat

SEQ ID NO: 483436 - DNA, 15 bp, Homo sapiens
agcatgagctaaatt

SEQ ID NO: 483437 - DNA, 15 bp, Homo sapiens
gcatgagctaaattt

SEQ ID NO: 483438 - DNA, 15 bp, Homo sapiens
catgagctaaatttg

SEQ ID NO: 483439 - DNA, 15 bp, Homo sapiens
atgagctaaatttga

SEQ ID NO: 483440 - DNA, 15 bp, Homo sapiens
tgagctaaatttgaa

SEQ ID NO: 483441 - DNA, 15 bp, Homo sapiens
gagctaaatttgaac

SEQ ID NO: 483442 - DNA, 15 bp, Homo sapiens
agctaaatttgaacc

SEQ ID NO: 483443 - DNA, 15 bp, Homo sapiens
gctaaatttgaacct

SEQ ID NO: 483444 - DNA, 15 bp, Homo sapiens
ctaaatttgaacctc

SEQ ID NO: 483445 - DNA, 15 bp, Homo sapiens
taaatttgaacctca

SEQ ID NO: 483446 - DNA, 15 bp, Homo sapiens
aaatttgaacctcac

SEQ ID NO: 483447 - DNA, 15 bp, Homo sapiens
aatttgaacctcaca

SEQ ID NO: 483448 - DNA, 15 bp, Homo sapiens
atttgaacctcacag

SEQ ID NO: 483449 - DNA, 15 bp, Homo sapiens
tttgaacctcacaga

SEQ ID NO: 483450 - DNA, 15 bp, Homo sapiens
ttgaacctcacagac

SEQ ID NO: 483451 - DNA, 15 bp, Homo sapiens
tgaacctcacagacg

SEQ ID NO: 483452 - DNA, 15 bp, Homo sapiens
gaacctcacagacga

SEQ ID NO: 483453 - DNA, 15 bp, Homo sapiens
aacctcacagacgat

SEQ ID NO: 483454 - DNA, 15 bp, Homo sapiens
acctcacagacgatt

SEQ ID NO: 483455 - DNA, 15 bp, Homo sapiens
cctcacagacgattt

SEQ ID NO: 483456 - DNA, 15 bp, Homo sapiens
ctcacagacgatttt

SEQ ID NO: 483457 - DNA, 15 bp, Homo sapiens
tcacagacgattttg

SEQ ID NO: 483458 - DNA, 15 bp, Homo sapiens
cacagacgattttgg

SEQ ID NO: 483459 - DNA, 15 bp, Homo sapiens
acagacgattttgga

SEQ ID NO: 483460 - DNA, 15 bp, Homo sapiens
cagacgattttggag

SEQ ID NO: 483461 - DNA, 15 bp, Homo sapiens
agacgattttggaga

SEQ ID NO: 483462 - DNA, 15 bp, Homo sapiens
gacgattttggagag

SEQ ID NO: 483463 - DNA, 15 bp, Homo sapiens
acgattttggagaga

SEQ ID NO: 483464 - DNA, 15 bp, Homo sapiens
cgattttggagagac

SEQ ID NO: 483465 - DNA, 15 bp, Homo sapiens
gattttggagagacg

SEQ ID NO: 483466 - DNA, 15 bp, Homo sapiens
attttggagagacga

SEQ ID NO: 483467 - DNA, 15 bp, Homo sapiens
ttttggagagacgat

SEQ ID NO: 483468 - DNA, 15 bp, Homo sapiens
tttggagagacgata

SEQ ID NO: 483469 - DNA, 15 bp, Homo sapiens
ttggagagacgataa

SEQ ID NO: 483470 - DNA, 15 bp, Homo sapiens
tggagagacgataat

SEQ ID NO: 483471 - DNA, 15 bp, Homo sapiens
ggagagacgataatg

SEQ ID NO: 483472 - DNA, 15 bp, Homo sapiens
gagagacgataatgc

SEQ ID NO: 483473 - DNA, 15 bp, Homo sapiens
agagacgataatgca

SEQ ID NO: 483474 - DNA, 15 bp, Homo sapiens
gagacgataatgcac

SEQ ID NO: 483475 - DNA, 15 bp, Homo sapiens
agacgataatgcacg

SEQ ID NO: 483476 - DNA, 15 bp, Homo sapiens
gacgataatgcacgt

SEQ ID NO: 483477 - DNA, 15 bp, Homo sapiens
acgataatgcacgtg

SEQ ID NO: 483478 - DNA, 15 bp, Homo sapiens
cgataatgcacgtgg

SEQ ID NO: 483479 - DNA, 15 bp, Homo sapiens
gataatgcacgtggt

SEQ ID NO: 483480 - DNA, 15 bp, Homo sapiens
ataatgcacgtggta

SEQ ID NO: 483481 - DNA, 15 bp, Homo sapiens
taatgcacgtggtag

SEQ ID NO: 483482 - DNA, 15 bp, Homo sapiens
aatgcacgtggtagt

SEQ ID NO: 483483 - DNA, 15 bp, Homo sapiens
atgcacgtggtagtc

SEQ ID NO: 483484 - DNA, 15 bp, Homo sapiens
tgcacgtggtagtca

SEQ ID NO: 483485 - DNA, 15 bp, Homo sapiens
gcacgtggtagtcat

SEQ ID NO: 483486 - DNA, 15 bp, Homo sapiens
cacgtggtagtcatt

SEQ ID NO: 483487 - DNA, 15 bp, Homo sapiens
acgtggtagtcattc

SEQ ID NO: 483488 - DNA, 15 bp, Homo sapiens
cgtggtagtcattct

SEQ ID NO: 483489 - DNA, 15 bp, Homo sapiens
gtggtagtcattctg

SEQ ID NO: 483490 - DNA, 15 bp, Homo sapiens
tggtagtcattctgt

SEQ ID NO: 483491 - DNA, 15 bp, Homo sapiens
ggtagtcattctgtt

SEQ ID NO: 483492 - DNA, 15 bp, Homo sapiens
gtagtcattctgttt

SEQ ID NO: 483493 - DNA, 15 bp, Homo sapiens
tagtcattctgtttc

SEQ ID NO: 483494 - DNA, 15 bp, Homo sapiens
agtcattctgtttct

SEQ ID NO: 483495 - DNA, 15 bp, Homo sapiens
gtcattctgtttctc

SEQ ID NO: 483496 - DNA, 15 bp, Homo sapiens
tcattctgtttctcc

SEQ ID NO: 483497 - DNA, 15 bp, Homo sapiens
cattctgtttctccc

SEQ ID NO: 483498 - DNA, 15 bp, Homo sapiens
attctgtttctccct

SEQ ID NO: 483499 - DNA, 15 bp, Homo sapiens
ttctgtttctccctc

SEQ ID NO: 483500 - DNA, 15 bp, Homo sapiens
tctgtttctccctct

SEQ ID NO: 483501 - DNA, 15 bp, Homo sapiens
ctgtttctccctctt

SEQ ID NO: 483502 - DNA, 15 bp, Homo sapiens
tgtttctccctcttt

SEQ ID NO: 483503 - DNA, 15 bp, Homo sapiens
gtttctccctctttc

SEQ ID NO: 483504 - DNA, 15 bp, Homo sapiens
tttctccctctttct

SEQ ID NO: 483505 - DNA, 15 bp, Homo sapiens
ttctccctctttctg

SEQ ID NO: 483506 - DNA, 15 bp, Homo sapiens
tctccctctttctgt

SEQ ID NO: 483507 - DNA, 15 bp, Homo sapiens
ctccctctttctgta

SEQ ID NO: 483508 - DNA, 15 bp, Homo sapiens
tccctctttctgtat

SEQ ID NO: 483509 - DNA, 15 bp, Homo sapiens
ccctctttctgtatt

SEQ ID NO: 483510 - DNA, 15 bp, Homo sapiens
cctctttctgtatta

SEQ ID NO: 483511 - DNA, 15 bp, Homo sapiens
ctctttctgtattag

SEQ ID NO: 483512 - DNA, 15 bp, Homo sapiens
tctttctgtattaga

SEQ ID NO: 483513 - DNA, 15 bp, Homo sapiens
ctttctgtattagaa

SEQ ID NO: 483514 - DNA, 15 bp, Homo sapiens
tttctgtattagaaa

SEQ ID NO: 483515 - DNA, 15 bp, Homo sapiens
ttctgtattagaaat

SEQ ID NO: 483516 - DNA, 15 bp, Homo sapiens
tctgtattagaaatc

SEQ ID NO: 483517 - DNA, 15 bp, Homo sapiens
ctgtattagaaatct

SEQ ID NO: 483518 - DNA, 15 bp, Homo sapiens
tgtattagaaatcta

SEQ ID NO: 483519 - DNA, 15 bp, Homo sapiens
gtattagaaatctac

SEQ ID NO: 483520 - DNA, 15 bp, Homo sapiens
tattagaaatctaca

SEQ ID NO: 483521 - DNA, 15 bp, Homo sapiens
attagaaatctacag

SEQ ID NO: 483522 - DNA, 15 bp, Homo sapiens
ttagaaatctacagg

SEQ ID NO: 483523 - DNA, 15 bp, Homo sapiens
tagaaatctacaggt

SEQ ID NO: 483524 - DNA, 15 bp, Homo sapiens
agaaatctacaggtg

SEQ ID NO: 483525 - DNA, 15 bp, Homo sapiens
gaaatctacaggtgg

SEQ ID NO: 483526 - DNA, 15 bp, Homo sapiens
aaatctacaggtgga

SEQ ID NO: 483527 - DNA, 15 bp, Homo sapiens
aatctacaggtggag

SEQ ID NO: 483528 - DNA, 15 bp, Homo sapiens
atctacaggtggagt

SEQ ID NO: 483529 - DNA, 15 bp, Homo sapiens
tctacaggtggagta

SEQ ID NO: 483530 - DNA, 15 bp, Homo sapiens
ctacaggtggagtat

SEQ ID NO: 483531 - DNA, 15 bp, Homo sapiens
tacaggtggagtatg

SEQ ID NO: 483532 - DNA, 15 bp, Homo sapiens
acaggtggagtatga

SEQ ID NO: 483533 - DNA, 15 bp, Homo sapiens
caggtggagtatgag

SEQ ID NO: 483534 - DNA, 15 bp, Homo sapiens
aggtggagtatgagc

SEQ ID NO: 483535 - DNA, 15 bp, Homo sapiens
ggtggagtatgagca

SEQ ID NO: 483536 - DNA, 15 bp, Homo sapiens
gtggagtatgagcag

SEQ ID NO: 483537 - DNA, 15 bp, Homo sapiens
tggagtatgagcagc

SEQ ID NO: 483538 - DNA, 15 bp, Homo sapiens
ggagtatgagcagct

SEQ ID NO: 483539 - DNA, 15 bp, Homo sapiens
gagtatgagcagctg

SEQ ID NO: 483540 - DNA, 15 bp, Homo sapiens
agtatgagcagctga

SEQ ID NO: 483541 - DNA, 15 bp, Homo sapiens
gtatgagcagctgaa

SEQ ID NO: 483542 - DNA, 15 bp, Homo sapiens
tatgagcagctgaag

SEQ ID NO: 483543 - DNA, 15 bp, Homo sapiens
atgagcagctgaagg

SEQ ID NO: 483544 - DNA, 15 bp, Homo sapiens
tgagcagctgaagga

SEQ ID NO: 483545 - DNA, 15 bp, Homo sapiens
gagcagctgaaggac

SEQ ID NO: 483546 - DNA, 15 bp, Homo sapiens
agcagctgaaggacc

SEQ ID NO: 483547 - DNA, 15 bp, Homo sapiens
gcagctgaaggacca

SEQ ID NO: 483548 - DNA, 15 bp, Homo sapiens
cagctgaaggaccag

SEQ ID NO: 483549 - DNA, 15 bp, Homo sapiens
agctgaaggaccagc

SEQ ID NO: 483550 - DNA, 15 bp, Homo sapiens
gctgaaggaccagca

SEQ ID NO: 483551 - DNA, 15 bp, Homo sapiens
ctgaaggaccagcac

SEQ ID NO: 483552 - DNA, 15 bp, Homo sapiens
tgaaggaccagcacc

SEQ ID NO: 483553 - DNA, 15 bp, Homo sapiens
gaaggaccagcacct

SEQ ID NO: 483554 - DNA, 15 bp, Homo sapiens
aaggaccagcacctc

SEQ ID NO: 483555 - DNA, 15 bp, Homo sapiens
aggaccagcacctcc

SEQ ID NO: 483556 - DNA, 15 bp, Homo sapiens
ggaccagcacctccg

SEQ ID NO: 483557 - DNA, 15 bp, Homo sapiens
gaccagcacctccga

SEQ ID NO: 483558 - DNA, 15 bp, Homo sapiens
accagcacctccgaa

SEQ ID NO: 483559 - DNA, 15 bp, Homo sapiens
ccagcacctccgaag

SEQ ID NO: 483560 - DNA, 15 bp, Homo sapiens
cagcacctccgaagg

SEQ ID NO: 483561 - DNA, 15 bp, Homo sapiens
agcacctccgaaggg

SEQ ID NO: 483562 - DNA, 15 bp, Homo sapiens
gcacctccgaagggg

SEQ ID NO: 483563 - DNA, 15 bp, Homo sapiens
cacctccgaaggggg

SEQ ID NO: 483564 - DNA, 15 bp, Homo sapiens
acctccgaagggggc

SEQ ID NO: 483565 - DNA, 15 bp, Homo sapiens
cctccgaagggggct

SEQ ID NO: 483566 - DNA, 15 bp, Homo sapiens
ctccgaagggggctc

SEQ ID NO: 483567 - DNA, 15 bp, Homo sapiens
tccgaagggggctcc

SEQ ID NO: 483568 - DNA, 15 bp, Homo sapiens
ccgaagggggctccc

SEQ ID NO: 483569 - DNA, 15 bp, Homo sapiens
cgaagggggctccct

SEQ ID NO: 483570 - DNA, 15 bp, Homo sapiens
gaagggggctccctg

SEQ ID NO: 483571 - DNA, 15 bp, Homo sapiens
aagggggctccctgt

SEQ ID NO: 483572 - DNA, 15 bp, Homo sapiens
agggggctccctgtc

SEQ ID NO: 483573 - DNA, 15 bp, Homo sapiens
gggggctccctgtcg

SEQ ID NO: 483574 - DNA, 15 bp, Homo sapiens
ggggctccctgtcgg

SEQ ID NO: 483575 - DNA, 15 bp, Homo sapiens
gggctccctgtcggt

SEQ ID NO: 483576 - DNA, 15 bp, Homo sapiens
ggctccctgtcggtt

SEQ ID NO: 483577 - DNA, 15 bp, Homo sapiens
gctccctgtcggttc

SEQ ID NO: 483578 - DNA, 15 bp, Homo sapiens
ctccctgtcggttca

SEQ ID NO: 483579 - DNA, 15 bp, Homo sapiens
tccctgtcggttcac

SEQ ID NO: 483580 - DNA, 15 bp, Homo sapiens
ccctgtcggttcacc

SEQ ID NO: 483581 - DNA, 15 bp, Homo sapiens
cctgtcggttcaccg

SEQ ID NO: 483582 - DNA, 15 bp, Homo sapiens
ctgtcggttcaccgc

SEQ ID NO: 483583 - DNA, 15 bp, Homo sapiens
tgtcggttcaccgcc

SEQ ID NO: 483584 - DNA, 15 bp, Homo sapiens
gtcggttcaccgcca

SEQ ID NO: 483585 - DNA, 15 bp, Homo sapiens
tcggttcaccgccag

SEQ ID NO: 483586 - DNA, 15 bp, Homo sapiens
cggttcaccgccaga

SEQ ID NO: 483587 - DNA, 15 bp, Homo sapiens
ggttcaccgccagag

SEQ ID NO: 483588 - DNA, 15 bp, Homo sapiens
gttcaccgccagagt

SEQ ID NO: 483589 - DNA, 15 bp, Homo sapiens
ttcaccgccagagtc

SEQ ID NO: 483590 - DNA, 15 bp, Homo sapiens
tcaccgccagagtcg

SEQ ID NO: 483591 - DNA, 15 bp, Homo sapiens
caccgccagagtcga

SEQ ID NO: 483592 - DNA, 15 bp, Homo sapiens
accgccagagtcgat

SEQ ID NO: 483593 - DNA, 15 bp, Homo sapiens
ccgccagagtcgatt

SEQ ID NO: 483594 - DNA, 15 bp, Homo sapiens
cgccagagtcgatta

SEQ ID NO: 483595 - DNA, 15 bp, Homo sapiens
gccagagtcgattat

SEQ ID NO: 483596 - DNA, 15 bp, Homo sapiens
ccagagtcgattata

SEQ ID NO: 483597 - DNA, 15 bp, Homo sapiens
cagagtcgattatat

SEQ ID NO: 483598 - DNA, 15 bp, Homo sapiens
agagtcgattatatc

SEQ ID NO: 483599 - DNA, 15 bp, Homo sapiens
gagtcgattatatct

SEQ ID NO: 483600 - DNA, 15 bp, Homo sapiens
agtcgattatatctc

SEQ ID NO: 483601 - DNA, 15 bp, Homo sapiens
gtcgattatatctcc

SEQ ID NO: 483602 - DNA, 15 bp, Homo sapiens
tcgattatatctccc

SEQ ID NO: 483603 - DNA, 15 bp, Homo sapiens
cgattatatctcccc

SEQ ID NO: 483604 - DNA, 15 bp, Homo sapiens
gattatatctcccca

SEQ ID NO: 483605 - DNA, 15 bp, Homo sapiens
attatatctccccat

SEQ ID NO: 483606 - DNA, 15 bp, Homo sapiens
ttatatctccccatc

SEQ ID NO: 483607 - DNA, 15 bp, Homo sapiens
tatatctccccatca

SEQ ID NO: 483608 - DNA, 15 bp, Homo sapiens
atatctccccatcac

SEQ ID NO: 483609 - DNA, 15 bp, Homo sapiens
tatctccccatcaca

SEQ ID NO: 483610 - DNA, 15 bp, Homo sapiens
atctccccatcacac

SEQ ID NO: 483611 - DNA, 15 bp, Homo sapiens
tctccccatcacacg

SEQ ID NO: 483612 - DNA, 15 bp, Homo sapiens
ctccccatcacacgt

SEQ ID NO: 483613 - DNA, 15 bp, Homo sapiens
tccccatcacacgtc

SEQ ID NO: 483614 - DNA, 15 bp, Homo sapiens
ccccatcacacgtct

SEQ ID NO: 483615 - DNA, 15 bp, Homo sapiens
cccatcacacgtctg

SEQ ID NO: 483616 - DNA, 15 bp, Homo sapiens
ccatcacacgtctga

SEQ ID NO: 483617 - DNA, 15 bp, Homo sapiens
catcacacgtctgag

SEQ ID NO: 483618 - DNA, 15 bp, Homo sapiens
atcacacgtctgagg

SEQ ID NO: 483619 - DNA, 15 bp, Homo sapiens
tcacacgtctgagga

SEQ ID NO: 483620 - DNA, 15 bp, Homo sapiens
cacacgtctgaggat

SEQ ID NO: 483621 - DNA, 15 bp, Homo sapiens
acacgtctgaggatt

SEQ ID NO: 483622 - DNA, 15 bp, Homo sapiens
cacgtctgaggattc

SEQ ID NO: 483623 - DNA, 15 bp, Homo sapiens
acgtctgaggattca

SEQ ID NO: 483624 - DNA, 15 bp, Homo sapiens
cgtctgaggattcag

SEQ ID NO: 483625 - DNA, 15 bp, Homo sapiens
gtctgaggattcaga

SEQ ID NO: 483626 - DNA, 15 bp, Homo sapiens
tctgaggattcagaa

SEQ ID NO: 483627 - DNA, 15 bp, Homo sapiens
ctgaggattcagaac

SEQ ID NO: 483628 - DNA, 15 bp, Homo sapiens
tgaggattcagaact

SEQ ID NO: 483629 - DNA, 15 bp, Homo sapiens
gaggattcagaactt

SEQ ID NO: 483630 - DNA, 15 bp, Homo sapiens
aggattcagaactta

SEQ ID NO: 483631 - DNA, 15 bp, Homo sapiens
ggattcagaacttat

SEQ ID NO: 483632 - DNA, 15 bp, Homo sapiens
gattcagaacttata

SEQ ID NO: 483633 - DNA, 15 bp, Homo sapiens
attcagaacttatag

SEQ ID NO: 483634 - DNA, 15 bp, Homo sapiens
ttcagaacttatagc

SEQ ID NO: 483635 - DNA, 15 bp, Homo sapiens
tcagaacttatagca

SEQ ID NO: 483636 - DNA, 15 bp, Homo sapiens
cagaacttatagcag

SEQ ID NO: 483637 - DNA, 15 bp, Homo sapiens
agaacttatagcaga

SEQ ID NO: 483638 - DNA, 15 bp, Homo sapiens
gaacttatagcagaa

SEQ ID NO: 483639 - DNA, 15 bp, Homo sapiens
aacttatagcagaag

SEQ ID NO: 483640 - DNA, 15 bp, Homo sapiens
acttatagcagaagc

SEQ ID NO: 483641 - DNA, 15 bp, Homo sapiens
cttatagcagaagca

SEQ ID NO: 483642 - DNA, 15 bp, Homo sapiens
ttatagcagaagcaa

SEQ ID NO: 483643 - DNA, 15 bp, Homo sapiens
tatagcagaagcaaa

SEQ ID NO: 483644 - DNA, 15 bp, Homo sapiens
atagcagaagcaaaa

SEQ ID NO: 483645 - DNA, 15 bp, Homo sapiens
tagcagaagcaaaac

SEQ ID NO: 483646 - DNA, 15 bp, Homo sapiens
agcagaagcaaaact

SEQ ID NO: 483647 - DNA, 15 bp, Homo sapiens
gcagaagcaaaactc

SEQ ID NO: 483648 - DNA, 15 bp, Homo sapiens
cagaagcaaaactcc

SEQ ID NO: 483649 - DNA, 15 bp, Homo sapiens
agaagcaaaactcct

SEQ ID NO: 483650 - DNA, 15 bp, Homo sapiens
gaagcaaaactcctc

SEQ ID NO: 483651 - DNA, 15 bp, Homo sapiens
aagcaaaactcctca

SEQ ID NO: 483652 - DNA, 15 bp, Homo sapiens
agcaaaactcctcag

SEQ ID NO: 483653 - DNA, 15 bp, Homo sapiens
gcaaaactcctcagg

SEQ ID NO: 483654 - DNA, 15 bp, Homo sapiens
caaaactcctcaggc

SEQ ID NO: 483655 - DNA, 15 bp, Homo sapiens
aaaactcctcaggca

SEQ ID NO: 483656 - DNA, 15 bp, Homo sapiens
aaactcctcaggcag

SEQ ID NO: 483657 - DNA, 15 bp, Homo sapiens
aactcctcaggcagc

SEQ ID NO: 483658 - DNA, 15 bp, Homo sapiens
actcctcaggcagca

SEQ ID NO: 483659 - DNA, 15 bp, Homo sapiens
ctcctcaggcagcac

SEQ ID NO: 483660 - DNA, 15 bp, Homo sapiens
tcctcaggcagcaca

SEQ ID NO: 483661 - DNA, 15 bp, Homo sapiens
cctcaggcagcacaa

SEQ ID NO: 483662 - DNA, 15 bp, Homo sapiens
ctcaggcagcacaaa

SEQ ID NO: 483663 - DNA, 15 bp, Homo sapiens
tcaggcagcacaaag

SEQ ID NO: 483664 - DNA, 15 bp, Homo sapiens
caggcagcacaaagg

SEQ ID NO: 483665 - DNA, 15 bp, Homo sapiens
aggcagcacaaaggt

SEQ ID NO: 483666 - DNA, 15 bp, Homo sapiens
ggcagcacaaaggtc

SEQ ID NO: 483667 - DNA, 15 bp, Homo sapiens
gcagcacaaaggtcg

SEQ ID NO: 483668 - DNA, 15 bp, Homo sapiens
cagcacaaaggtcgg

SEQ ID NO: 483669 - DNA, 15 bp, Homo sapiens
agcacaaaggtcggc

SEQ ID NO: 483670 - DNA, 15 bp, Homo sapiens
gcacaaaggtcggct

SEQ ID NO: 483671 - DNA, 15 bp, Homo sapiens
cacaaaggtcggctg

SEQ ID NO: 483672 - DNA, 15 bp, Homo sapiens
acaaaggtcggctgg

SEQ ID NO: 483673 - DNA, 15 bp, Homo sapiens
caaaggtcggctgga

SEQ ID NO: 483674 - DNA, 15 bp, Homo sapiens
aaaggtcggctggag

SEQ ID NO: 483675 - DNA, 15 bp, Homo sapiens
aaggtcggctggagg

SEQ ID NO: 483676 - DNA, 15 bp, Homo sapiens
aggtcggctggaggc

SEQ ID NO: 483677 - DNA, 15 bp, Homo sapiens
ggtcggctggaggct

SEQ ID NO: 483678 - DNA, 15 bp, Homo sapiens
gtcggctggaggcta

SEQ ID NO: 483679 - DNA, 15 bp, Homo sapiens
tcggctggaggctag

SEQ ID NO: 483680 - DNA, 15 bp, Homo sapiens
cggctggaggctagg

SEQ ID NO: 483681 - DNA, 15 bp, Homo sapiens
ggctggaggctagga

SEQ ID NO: 483682 - DNA, 15 bp, Homo sapiens
gctggaggctaggat

SEQ ID NO: 483683 - DNA, 15 bp, Homo sapiens
ctggaggctaggatg

SEQ ID NO: 483684 - DNA, 15 bp, Homo sapiens
tggaggctaggatgc

SEQ ID NO: 483685 - DNA, 15 bp, Homo sapiens
ggaggctaggatgca

SEQ ID NO: 483686 - DNA, 15 bp, Homo sapiens
gaggctaggatgcag

SEQ ID NO: 483687 - DNA, 15 bp, Homo sapiens
aggctaggatgcaga

SEQ ID NO: 483688 - DNA, 15 bp, Homo sapiens
ggctaggatgcagat

SEQ ID NO: 483689 - DNA, 15 bp, Homo sapiens
gctaggatgcagatt

SEQ ID NO: 483690 - DNA, 15 bp, Homo sapiens
ctaggatgcagattt

SEQ ID NO: 483691 - DNA, 15 bp, Homo sapiens
taggatgcagatttt

SEQ ID NO: 483692 - DNA, 15 bp, Homo sapiens
aggatgcagatttta

SEQ ID NO: 483693 - DNA, 15 bp, Homo sapiens
ggatgcagattttag

SEQ ID NO: 483694 - DNA, 15 bp, Homo sapiens
gatgcagattttaga

SEQ ID NO: 483695 - DNA, 15 bp, Homo sapiens
atgcagattttagaa

SEQ ID NO: 483696 - DNA, 15 bp, Homo sapiens
tgcagattttagaag

SEQ ID NO: 483697 - DNA, 15 bp, Homo sapiens
gcagattttagaaga

SEQ ID NO: 483698 - DNA, 15 bp, Homo sapiens
cagattttagaagat

SEQ ID NO: 483699 - DNA, 15 bp, Homo sapiens
agattttagaagatc

SEQ ID NO: 483700 - DNA, 15 bp, Homo sapiens
gattttagaagatca

SEQ ID NO: 483701 - DNA, 15 bp, Homo sapiens
attttagaagatcac

SEQ ID NO: 483702 - DNA, 15 bp, Homo sapiens
ttttagaagatcaca

SEQ ID NO: 483703 - DNA, 15 bp, Homo sapiens
tttagaagatcacaa

SEQ ID NO: 483704 - DNA, 15 bp, Homo sapiens
ttagaagatcacaat

SEQ ID NO: 483705 - DNA, 15 bp, Homo sapiens
tagaagatcacaata

SEQ ID NO: 483706 - DNA, 15 bp, Homo sapiens
agaagatcacaataa

SEQ ID NO: 483707 - DNA, 15 bp, Homo sapiens
gaagatcacaataaa

SEQ ID NO: 483708 - DNA, 15 bp, Homo sapiens
aagatcacaataaac

SEQ ID NO: 483709 - DNA, 15 bp, Homo sapiens
agatcacaataaaca

SEQ ID NO: 483710 - DNA, 15 bp, Homo sapiens
gatcacaataaacag

SEQ ID NO: 483711 - DNA, 15 bp, Homo sapiens
atcacaataaacagc

SEQ ID NO: 483712 - DNA, 15 bp, Homo sapiens
tcacaataaacagct

SEQ ID NO: 483713 - DNA, 15 bp, Homo sapiens
cacaataaacagctg

SEQ ID NO: 483714 - DNA, 15 bp, Homo sapiens
acaataaacagctgg

SEQ ID NO: 483715 - DNA, 15 bp, Homo sapiens
caataaacagctgga

SEQ ID NO: 483716 - DNA, 15 bp, Homo sapiens
aataaacagctggag

SEQ ID NO: 483717 - DNA, 15 bp, Homo sapiens
ataaacagctggagt

SEQ ID NO: 483718 - DNA, 15 bp, Homo sapiens
taaacagctggagtc

SEQ ID NO: 483719 - DNA, 15 bp, Homo sapiens
aaacagctggagtct

SEQ ID NO: 483720 - DNA, 15 bp, Homo sapiens
aacagctggagtctc

SEQ ID NO: 483721 - DNA, 15 bp, Homo sapiens
acagctggagtctca

SEQ ID NO: 483722 - DNA, 15 bp, Homo sapiens
cagctggagtctcag

SEQ ID NO: 483723 - DNA, 15 bp, Homo sapiens
agctggagtctcagc

SEQ ID NO: 483724 - DNA, 15 bp, Homo sapiens
gctggagtctcagct

SEQ ID NO: 483725 - DNA, 15 bp, Homo sapiens
ctggagtctcagctc

SEQ ID NO: 483726 - DNA, 15 bp, Homo sapiens
tggagtctcagctcc

SEQ ID NO: 483727 - DNA, 15 bp, Homo sapiens
ggagtctcagctcca

SEQ ID NO: 483728 - DNA, 15 bp, Homo sapiens
gagtctcagctccac

SEQ ID NO: 483729 - DNA, 15 bp, Homo sapiens
agtctcagctccacc

SEQ ID NO: 483730 - DNA, 15 bp, Homo sapiens
gtctcagctccaccg

SEQ ID NO: 483731 - DNA, 15 bp, Homo sapiens
tctcagctccaccgc

SEQ ID NO: 483732 - DNA, 15 bp, Homo sapiens
ctcagctccaccgcc

SEQ ID NO: 483733 - DNA, 15 bp, Homo sapiens
tcagctccaccgcct

SEQ ID NO: 483734 - DNA, 15 bp, Homo sapiens
cagctccaccgcctc

SEQ ID NO: 483735 - DNA, 15 bp, Homo sapiens
agctccaccgcctcc

SEQ ID NO: 483736 - DNA, 15 bp, Homo sapiens
gctccaccgcctccg

SEQ ID NO: 483737 - DNA, 15 bp, Homo sapiens
ctccaccgcctccga

SEQ ID NO: 483738 - DNA, 15 bp, Homo sapiens
tccaccgcctccgac

SEQ ID NO: 483739 - DNA, 15 bp, Homo sapiens
ccaccgcctccgaca

SEQ ID NO: 483740 - DNA, 15 bp, Homo sapiens
caccgcctccgacag

SEQ ID NO: 483741 - DNA, 15 bp, Homo sapiens
accgcctccgacagc

SEQ ID NO: 483742 - DNA, 15 bp, Homo sapiens
ccgcctccgacagct

SEQ ID NO: 483743 - DNA, 15 bp, Homo sapiens
cgcctccgacagctg

SEQ ID NO: 483744 - DNA, 15 bp, Homo sapiens
gcctccgacagctgc

SEQ ID NO: 483745 - DNA, 15 bp, Homo sapiens
cctccgacagctgct

SEQ ID NO: 483746 - DNA, 15 bp, Homo sapiens
ctccgacagctgctg

SEQ ID NO: 483747 - DNA, 15 bp, Homo sapiens
tccgacagctgctgg

SEQ ID NO: 483748 - DNA, 15 bp, Homo sapiens
ccgacagctgctgga

SEQ ID NO: 483749 - DNA, 15 bp, Homo sapiens
cgacagctgctggag

SEQ ID NO: 483750 - DNA, 15 bp, Homo sapiens
gacagctgctggagc

SEQ ID NO: 483751 - DNA, 15 bp, Homo sapiens
acagctgctggagca

SEQ ID NO: 483752 - DNA, 15 bp, Homo sapiens
cagctgctggagcag

SEQ ID NO: 483753 - DNA, 15 bp, Homo sapiens
agctgctggagcagg

SEQ ID NO: 483754 - DNA, 15 bp, Homo sapiens
gctgctggagcaggt

SEQ ID NO: 483755 - DNA, 15 bp, Homo sapiens
ctgctggagcaggta

SEQ ID NO: 483756 - DNA, 15 bp, Homo sapiens
tgctggagcaggtag

SEQ ID NO: 483757 - DNA, 15 bp, Homo sapiens
gctggagcaggtagg

SEQ ID NO: 483758 - DNA, 15 bp, Homo sapiens
ctggagcaggtaggg

SEQ ID NO: 483759 - DNA, 15 bp, Homo sapiens
tggagcaggtagggt

SEQ ID NO: 483760 - DNA, 15 bp, Homo sapiens
ggagcaggtagggtg

SEQ ID NO: 483761 - DNA, 15 bp, Homo sapiens
gagcaggtagggtgt

SEQ ID NO: 483762 - DNA, 15 bp, Homo sapiens
agcaggtagggtgtg

SEQ ID NO: 483763 - DNA, 15 bp, Homo sapiens
gcaggtagggtgtgt

SEQ ID NO: 483764 - DNA, 15 bp, Homo sapiens
caggtagggtgtgta

SEQ ID NO: 483765 - DNA, 15 bp, Homo sapiens
aggtagggtgtgtag

SEQ ID NO: 483766 - DNA, 15 bp, Homo sapiens
ggtagggtgtgtaga

SEQ ID NO: 483767 - DNA, 15 bp, Homo sapiens
gtagggtgtgtagaa

SEQ ID NO: 483768 - DNA, 15 bp, Homo sapiens
tagggtgtgtagaat

SEQ ID NO: 483769 - DNA, 15 bp, Homo sapiens
agggtgtgtagaatt

SEQ ID NO: 483770 - DNA, 15 bp, Homo sapiens
gggtgtgtagaattc

SEQ ID NO: 483771 - DNA, 15 bp, Homo sapiens
ggtgtgtagaattca

SEQ ID NO: 483772 - DNA, 15 bp, Homo sapiens
gtgtgtagaattcag

SEQ ID NO: 483773 - DNA, 15 bp, Homo sapiens
tgtgtagaattcagc

SEQ ID NO: 483774 - DNA, 15 bp, Homo sapiens
gtgtagaattcagcg

SEQ ID NO: 483775 - DNA, 15 bp, Homo sapiens
tgtagaattcagcgt

SEQ ID NO: 483776 - DNA, 15 bp, Homo sapiens
gtagaattcagcgtc

SEQ ID NO: 483777 - DNA, 15 bp, Homo sapiens
tagaattcagcgtca

SEQ ID NO: 483778 - DNA, 15 bp, Homo sapiens
agaattcagcgtcac

SEQ ID NO: 483779 - DNA, 15 bp, Homo sapiens
gaattcagcgtcaca

SEQ ID NO: 483780 - DNA, 15 bp, Homo sapiens
aattcagcgtcacac

SEQ ID NO: 483781 - DNA, 15 bp, Homo sapiens
attcagcgtcacacc

SEQ ID NO: 483782 - DNA, 15 bp, Homo sapiens
ttcagcgtcacacct

SEQ ID NO: 483783 - DNA, 15 bp, Homo sapiens
tcagcgtcacacctc

SEQ ID NO: 483784 - DNA, 15 bp, Homo sapiens
cagcgtcacacctcc

SEQ ID NO: 483785 - DNA, 15 bp, Homo sapiens
agcgtcacacctccc

SEQ ID NO: 483786 - DNA, 15 bp, Homo sapiens
gcgtcacacctcccc

SEQ ID NO: 483787 - DNA, 15 bp, Homo sapiens
cgtcacacctcccca

SEQ ID NO: 483788 - DNA, 15 bp, Homo sapiens
gtcacacctccccag

SEQ ID NO: 483789 - DNA, 15 bp, Homo sapiens
tcacacctccccagg

SEQ ID NO: 483790 - DNA, 15 bp, Homo sapiens
cacacctccccaggc

SEQ ID NO: 483791 - DNA, 15 bp, Homo sapiens
acacctccccaggcc

SEQ ID NO: 483792 - DNA, 15 bp, Homo sapiens
cacctccccaggcca

SEQ ID NO: 483793 - DNA, 15 bp, Homo sapiens
acctccccaggccat

SEQ ID NO: 483794 - DNA, 15 bp, Homo sapiens
cctccccaggccatc

SEQ ID NO: 483795 - DNA, 15 bp, Homo sapiens
ctccccaggccatct

SEQ ID NO: 483796 - DNA, 15 bp, Homo sapiens
tccccaggccatctg

SEQ ID NO: 483797 - DNA, 15 bp, Homo sapiens
ccccaggccatctgt

SEQ ID NO: 483798 - DNA, 15 bp, Homo sapiens
cccaggccatctgtc

SEQ ID NO: 483799 - DNA, 15 bp, Homo sapiens
ccaggccatctgtcc

SEQ ID NO: 483800 - DNA, 15 bp, Homo sapiens
caggccatctgtcca

SEQ ID NO: 483801 - DNA, 15 bp, Homo sapiens
aggccatctgtccac

SEQ ID NO: 483802 - DNA, 15 bp, Homo sapiens
ggccatctgtccact

SEQ ID NO: 483803 - DNA, 15 bp, Homo sapiens
gccatctgtccactg

SEQ ID NO: 483804 - DNA, 15 bp, Homo sapiens
ccatctgtccactgc

SEQ ID NO: 483805 - DNA, 15 bp, Homo sapiens
catctgtccactgcc

SEQ ID NO: 483806 - DNA, 15 bp, Homo sapiens
atctgtccactgccc

SEQ ID NO: 483807 - DNA, 15 bp, Homo sapiens
tctgtccactgccct

SEQ ID NO: 483808 - DNA, 15 bp, Homo sapiens
ctgtccactgccctg

SEQ ID NO: 483809 - DNA, 15 bp, Homo sapiens
tgtccactgccctgg

SEQ ID NO: 483810 - DNA, 15 bp, Homo sapiens
gtccactgccctggg

SEQ ID NO: 483811 - DNA, 15 bp, Homo sapiens
tccactgccctggga

SEQ ID NO: 483812 - DNA, 15 bp, Homo sapiens
ccactgccctgggag

SEQ ID NO: 483813 - DNA, 15 bp, Homo sapiens
cactgccctgggaga

SEQ ID NO: 483814 - DNA, 15 bp, Homo sapiens
actgccctgggagat

SEQ ID NO: 483815 - DNA, 15 bp, Homo sapiens
ctgccctgggagatg

SEQ ID NO: 483816 - DNA, 15 bp, Homo sapiens
tgccctgggagatga

SEQ ID NO: 483817 - DNA, 15 bp, Homo sapiens
gccctgggagatgat

SEQ ID NO: 483818 - DNA, 15 bp, Homo sapiens
ccctgggagatgatg

SEQ ID NO: 483819 - DNA, 15 bp, Homo sapiens
cctgggagatgatgg

SEQ ID NO: 483820 - DNA, 15 bp, Homo sapiens
ctgggagatgatggt

SEQ ID NO: 483821 - DNA, 15 bp, Homo sapiens
tgggagatgatggtc

SEQ ID NO: 483822 - DNA, 15 bp, Homo sapiens
gggagatgatggtcc

SEQ ID NO: 483823 - DNA, 15 bp, Homo sapiens
ggagatgatggtcca

SEQ ID NO: 483824 - DNA, 15 bp, Homo sapiens
gagatgatggtccag

SEQ ID NO: 483825 - DNA, 15 bp, Homo sapiens
agatgatggtccagg

SEQ ID NO: 483826 - DNA, 15 bp, Homo sapiens
gatgatggtccaggt

SEQ ID NO: 483827 - DNA, 15 bp, Homo sapiens
atgatggtccaggtg

SEQ ID NO: 483828 - DNA, 15 bp, Homo sapiens
tgatggtccaggtgt

SEQ ID NO: 483829 - DNA, 15 bp, Homo sapiens
gatggtccaggtgtc

SEQ ID NO: 483830 - DNA, 15 bp, Homo sapiens
atggtccaggtgtca

SEQ ID NO: 483831 - DNA, 15 bp, Homo sapiens
tggtccaggtgtcag

SEQ ID NO: 483832 - DNA, 15 bp, Homo sapiens
ggtccaggtgtcagg

SEQ ID NO: 483833 - DNA, 15 bp, Homo sapiens
gtccaggtgtcagga

SEQ ID NO: 483834 - DNA, 15 bp, Homo sapiens
tccaggtgtcaggag

SEQ ID NO: 483835 - DNA, 15 bp, Homo sapiens
ccaggtgtcaggaga

SEQ ID NO: 483836 - DNA, 15 bp, Homo sapiens
caggtgtcaggagag

SEQ ID NO: 483837 - DNA, 15 bp, Homo sapiens
aggtgtcaggagagg

SEQ ID NO: 483838 - DNA, 15 bp, Homo sapiens
ggtgtcaggagaggc

SEQ ID NO: 483839 - DNA, 15 bp, Homo sapiens
gtgtcaggagaggca

SEQ ID NO: 483840 - DNA, 15 bp, Homo sapiens
tgtcaggagaggcag

SEQ ID NO: 483841 - DNA, 15 bp, Homo sapiens
gtcaggagaggcaga

SEQ ID NO: 483842 - DNA, 15 bp, Homo sapiens
tcaggagaggcagag

SEQ ID NO: 483843 - DNA, 15 bp, Homo sapiens
caggagaggcagaga

SEQ ID NO: 483844 - DNA, 15 bp, Homo sapiens
aggagaggcagagaa

SEQ ID NO: 483845 - DNA, 15 bp, Homo sapiens
ggagaggcagagaag

SEQ ID NO: 483846 - DNA, 15 bp, Homo sapiens
gagaggcagagaagt

SEQ ID NO: 483847 - DNA, 15 bp, Homo sapiens
agaggcagagaagtc

SEQ ID NO: 483848 - DNA, 15 bp, Homo sapiens
gaggcagagaagtcc

SEQ ID NO: 483849 - DNA, 15 bp, Homo sapiens
aggcagagaagtcca

SEQ ID NO: 483850 - DNA, 15 bp, Homo sapiens
ggcagagaagtccac

SEQ ID NO: 483851 - DNA, 15 bp, Homo sapiens
gcagagaagtccact

SEQ ID NO: 483852 - DNA, 15 bp, Homo sapiens
cagagaagtccactt

SEQ ID NO: 483853 - DNA, 15 bp, Homo sapiens
agagaagtccacttt

SEQ ID NO: 483854 - DNA, 15 bp, Homo sapiens
gagaagtccactttc

SEQ ID NO: 483855 - DNA, 15 bp, Homo sapiens
agaagtccactttca

SEQ ID NO: 483856 - DNA, 15 bp, Homo sapiens
gaagtccactttcaa

SEQ ID NO: 483857 - DNA, 15 bp, Homo sapiens
aagtccactttcaat

SEQ ID NO: 483858 - DNA, 15 bp, Homo sapiens
agtccactttcaatt

SEQ ID NO: 483859 - DNA, 15 bp, Homo sapiens
gtccactttcaattt

SEQ ID NO: 483860 - DNA, 15 bp, Homo sapiens
tccactttcaatttc

SEQ ID NO: 483861 - DNA, 15 bp, Homo sapiens
ccactttcaatttct

SEQ ID NO: 483862 - DNA, 15 bp, Homo sapiens
cactttcaatttctt

SEQ ID NO: 483863 - DNA, 15 bp, Homo sapiens
actttcaatttctta

SEQ ID NO: 483864 - DNA, 15 bp, Homo sapiens
ctttcaatttcttac

SEQ ID NO: 483865 - DNA, 15 bp, Homo sapiens
tttcaatttcttacc

SEQ ID NO: 483866 - DNA, 15 bp, Homo sapiens
ttcaatttcttacct

SEQ ID NO: 483867 - DNA, 15 bp, Homo sapiens
tcaatttcttacctc

SEQ ID NO: 483868 - DNA, 15 bp, Homo sapiens
caatttcttacctcc

SEQ ID NO: 483869 - DNA, 15 bp, Homo sapiens
aatttcttacctccg

SEQ ID NO: 483870 - DNA, 15 bp, Homo sapiens
atttcttacctccgt

SEQ ID NO: 483871 - DNA, 15 bp, Homo sapiens
tttcttacctccgta

SEQ ID NO: 483872 - DNA, 15 bp, Homo sapiens
ttcttacctccgtag

SEQ ID NO: 483873 - DNA, 15 bp, Homo sapiens
tcttacctccgtagt

SEQ ID NO: 483874 - DNA, 15 bp, Homo sapiens
cttacctccgtagtt

SEQ ID NO: 483875 - DNA, 15 bp, Homo sapiens
ttacctccgtagtta

SEQ ID NO: 483876 - DNA, 15 bp, Homo sapiens
tacctccgtagttaa

SEQ ID NO: 483877 - DNA, 15 bp, Homo sapiens
acctccgtagttaat

SEQ ID NO: 483878 - DNA, 15 bp, Homo sapiens
cctccgtagttaatt

SEQ ID NO: 483879 - DNA, 15 bp, Homo sapiens
ctccgtagttaattc

SEQ ID NO: 483880 - DNA, 15 bp, Homo sapiens
tccgtagttaattca

SEQ ID NO: 483881 - DNA, 15 bp, Homo sapiens
ccgtagttaattcag

SEQ ID NO: 483882 - DNA, 15 bp, Homo sapiens
cgtagttaattcaga

SEQ ID NO: 483883 - DNA, 15 bp, Homo sapiens
gtagttaattcagac

SEQ ID NO: 483884 - DNA, 15 bp, Homo sapiens
tagttaattcagact

SEQ ID NO: 483885 - DNA, 15 bp, Homo sapiens
agttaattcagactg

SEQ ID NO: 483886 - DNA, 15 bp, Homo sapiens
gttaattcagactgg

SEQ ID NO: 483887 - DNA, 15 bp, Homo sapiens
ttaattcagactggc

SEQ ID NO: 483888 - DNA, 15 bp, Homo sapiens
taattcagactggct

SEQ ID NO: 483889 - DNA, 15 bp, Homo sapiens
aattcagactggctt

SEQ ID NO: 483890 - DNA, 15 bp, Homo sapiens
attcagactggctta

SEQ ID NO: 483891 - DNA, 15 bp, Homo sapiens
ttcagactggcttag

SEQ ID NO: 483892 - DNA, 15 bp, Homo sapiens
tcagactggcttaga

SEQ ID NO: 483893 - DNA, 15 bp, Homo sapiens
cagactggcttagaa

SEQ ID NO: 483894 - DNA, 15 bp, Homo sapiens
agactggcttagaaa

SEQ ID NO: 483895 - DNA, 15 bp, Homo sapiens
gactggcttagaaat

SEQ ID NO: 483896 - DNA, 15 bp, Homo sapiens
actggcttagaaatt

SEQ ID NO: 483897 - DNA, 15 bp, Homo sapiens
ctggcttagaaattt

SEQ ID NO: 483898 - DNA, 15 bp, Homo sapiens
tggcttagaaatttc

SEQ ID NO: 483899 - DNA, 15 bp, Homo sapiens
ggcttagaaatttcc

SEQ ID NO: 483900 - DNA, 15 bp, Homo sapiens
gcttagaaatttcct

SEQ ID NO: 483901 - DNA, 15 bp, Homo sapiens
cttagaaatttcctt

SEQ ID NO: 483902 - DNA, 15 bp, Homo sapiens
ttagaaatttccttt

SEQ ID NO: 483903 - DNA, 15 bp, Homo sapiens
tagaaatttcctttt

SEQ ID NO: 483904 - DNA, 15 bp, Homo sapiens
agaaatttcctttta

SEQ ID NO: 483905 - DNA, 15 bp, Homo sapiens
gaaatttccttttac

SEQ ID NO: 483906 - DNA, 15 bp, Homo sapiens
aaatttccttttaca

SEQ ID NO: 483907 - DNA, 15 bp, Homo sapiens
aatttccttttacat

SEQ ID NO: 483908 - DNA, 15 bp, Homo sapiens
atttccttttacatg

SEQ ID NO: 483909 - DNA, 15 bp, Homo sapiens
tttccttttacatgt

SEQ ID NO: 483910 - DNA, 15 bp, Homo sapiens
ttccttttacatgta

SEQ ID NO: 483911 - DNA, 15 bp, Homo sapiens
tccttttacatgtaa

SEQ ID NO: 483912 - DNA, 15 bp, Homo sapiens
ccttttacatgtaag

SEQ ID NO: 483913 - DNA, 15 bp, Homo sapiens
cttttacatgtaagc

SEQ ID NO: 483914 - DNA, 15 bp, Homo sapiens
ttttacatgtaagca

SEQ ID NO: 483915 - DNA, 15 bp, Homo sapiens
tttacatgtaagcat

SEQ ID NO: 483916 - DNA, 15 bp, Homo sapiens
ttacatgtaagcata

SEQ ID NO: 483917 - DNA, 15 bp, Homo sapiens
tacatgtaagcatat

SEQ ID NO: 483918 - DNA, 15 bp, Homo sapiens
acatgtaagcatata

SEQ ID NO: 483919 - DNA, 15 bp, Homo sapiens
catgtaagcatataa

SEQ ID NO: 483920 - DNA, 15 bp, Homo sapiens
atgtaagcatataaa

SEQ ID NO: 483921 - DNA, 15 bp, Homo sapiens
tgtaagcatataaat

SEQ ID NO: 483922 - DNA, 15 bp, Homo sapiens
gtaagcatataaatc

SEQ ID NO: 483923 - DNA, 15 bp, Homo sapiens
taagcatataaatcc

SEQ ID NO: 483924 - DNA, 15 bp, Homo sapiens
aagcatataaatcct

SEQ ID NO: 483925 - DNA, 15 bp, Homo sapiens
agcatataaatcctc

SEQ ID NO: 483926 - DNA, 15 bp, Homo sapiens
gcatataaatcctca

SEQ ID NO: 483927 - DNA, 15 bp, Homo sapiens
catataaatcctcat

SEQ ID NO: 483928 - DNA, 15 bp, Homo sapiens
atataaatcctcatt

SEQ ID NO: 483929 - DNA, 15 bp, Homo sapiens
tataaatcctcattg

SEQ ID NO: 483930 - DNA, 15 bp, Homo sapiens
ataaatcctcattgg

SEQ ID NO: 483931 - DNA, 15 bp, Homo sapiens
taaatcctcattggc

SEQ ID NO: 483932 - DNA, 15 bp, Homo sapiens
aaatcctcattggca

SEQ ID NO: 483933 - DNA, 15 bp, Homo sapiens
aatcctcattggcac

SEQ ID NO: 483934 - DNA, 15 bp, Homo sapiens
atcctcattggcaca

SEQ ID NO: 483935 - DNA, 15 bp, Homo sapiens
tcctcattggcacac

SEQ ID NO: 483936 - DNA, 15 bp, Homo sapiens
cctcattggcacaca

SEQ ID NO: 483937 - DNA, 15 bp, Homo sapiens
ctcattggcacacaa

SEQ ID NO: 483938 - DNA, 15 bp, Homo sapiens
tcattggcacacaaa

SEQ ID NO: 483939 - DNA, 15 bp, Homo sapiens
cattggcacacaaaa

SEQ ID NO: 483940 - DNA, 15 bp, Homo sapiens
attggcacacaaaaa

SEQ ID NO: 483941 - DNA, 15 bp, Homo sapiens
ttggcacacaaaaat

SEQ ID NO: 483942 - DNA, 15 bp, Homo sapiens
tggcacacaaaaatg

SEQ ID NO: 483943 - DNA, 15 bp, Homo sapiens
ggcacacaaaaatgt

SEQ ID NO: 483944 - DNA, 15 bp, Homo sapiens
gcacacaaaaatgtg

SEQ ID NO: 483945 - DNA, 15 bp, Homo sapiens
cacacaaaaatgtgt

SEQ ID NO: 483946 - DNA, 15 bp, Homo sapiens
acacaaaaatgtgtt

SEQ ID NO: 483947 - DNA, 15 bp, Homo sapiens
cacaaaaatgtgttt

SEQ ID NO: 483948 - DNA, 15 bp, Homo sapiens
acaaaaatgtgtttg

SEQ ID NO: 483949 - DNA, 15 bp, Homo sapiens
caaaaatgtgtttgc

SEQ ID NO: 483950 - DNA, 15 bp, Homo sapiens
aaaaatgtgtttgcc

SEQ ID NO: 483951 - DNA, 15 bp, Homo sapiens
aaaatgtgtttgccc

SEQ ID NO: 483952 - DNA, 15 bp, Homo sapiens
aaatgtgtttgccca

SEQ ID NO: 483953 - DNA, 15 bp, Homo sapiens
aatgtgtttgcccag

SEQ ID NO: 483954 - DNA, 15 bp, Homo sapiens
atgtgtttgcccagc

SEQ ID NO: 483955 - DNA, 15 bp, Homo sapiens
tgtgtttgcccagct

SEQ ID NO: 483956 - DNA, 15 bp, Homo sapiens
gtgtttgcccagctt

SEQ ID NO: 483957 - DNA, 15 bp, Homo sapiens
tgtttgcccagctta

SEQ ID NO: 483958 - DNA, 15 bp, Homo sapiens
gtttgcccagcttac

SEQ ID NO: 483959 - DNA, 15 bp, Homo sapiens
tttgcccagcttaca

SEQ ID NO: 483960 - DNA, 15 bp, Homo sapiens
ttgcccagcttacaa

SEQ ID NO: 483961 - DNA, 15 bp, Homo sapiens
tgcccagcttacaat

SEQ ID NO: 483962 - DNA, 15 bp, Homo sapiens
gcccagcttacaatg

SEQ ID NO: 483963 - DNA, 15 bp, Homo sapiens
cccagcttacaatgg

SEQ ID NO: 483964 - DNA, 15 bp, Homo sapiens
ccagcttacaatgga

SEQ ID NO: 483965 - DNA, 15 bp, Homo sapiens
cagcttacaatggaa

SEQ ID NO: 483966 - DNA, 15 bp, Homo sapiens
agcttacaatggaat

SEQ ID NO: 483967 - DNA, 15 bp, Homo sapiens
gcttacaatggaatt

SEQ ID NO: 483968 - DNA, 15 bp, Homo sapiens
cttacaatggaattt

SEQ ID NO: 483969 - DNA, 15 bp, Homo sapiens
ttacaatggaatttc

SEQ ID NO: 483970 - DNA, 15 bp, Homo sapiens
tacaatggaatttcc

SEQ ID NO: 483971 - DNA, 15 bp, Homo sapiens
acaatggaatttccc

SEQ ID NO: 483972 - DNA, 15 bp, Homo sapiens
caatggaatttccca

SEQ ID NO: 483973 - DNA, 15 bp, Homo sapiens
aatggaatttcccag

SEQ ID NO: 483974 - DNA, 15 bp, Homo sapiens
atggaatttcccagt

SEQ ID NO: 483975 - DNA, 15 bp, Homo sapiens
tggaatttcccagtc

SEQ ID NO: 483976 - DNA, 15 bp, Homo sapiens
ggaatttcccagtct

SEQ ID NO: 483977 - DNA, 15 bp, Homo sapiens
gaatttcccagtctt

SEQ ID NO: 483978 - DNA, 15 bp, Homo sapiens
aatttcccagtcttc

SEQ ID NO: 483979 - DNA, 15 bp, Homo sapiens
atttcccagtcttct

SEQ ID NO: 483980 - DNA, 15 bp, Homo sapiens
tttcccagtcttctt

SEQ ID NO: 483981 - DNA, 15 bp, Homo sapiens
ttcccagtcttcttt

SEQ ID NO: 483982 - DNA, 15 bp, Homo sapiens
tcccagtcttcttta

SEQ ID NO: 483983 - DNA, 15 bp, Homo sapiens
cccagtcttctttaa

SEQ ID NO: 483984 - DNA, 15 bp, Homo sapiens
ccagtcttctttaac

SEQ ID NO: 483985 - DNA, 15 bp, Homo sapiens
cagtcttctttaaca

SEQ ID NO: 483986 - DNA, 15 bp, Homo sapiens
agtcttctttaacaa

SEQ ID NO: 483987 - DNA, 15 bp, Homo sapiens
gtcttctttaacaat

SEQ ID NO: 483988 - DNA, 15 bp, Homo sapiens
tcttctttaacaatg

SEQ ID NO: 483989 - DNA, 15 bp, Homo sapiens
cttctttaacaatga

SEQ ID NO: 483990 - DNA, 15 bp, Homo sapiens
ttctttaacaatgaa

SEQ ID NO: 483991 - DNA, 15 bp, Homo sapiens
tctttaacaatgaag

SEQ ID NO: 483992 - DNA, 15 bp, Homo sapiens
ctttaacaatgaagt

SEQ ID NO: 483993 - DNA, 15 bp, Homo sapiens
tttaacaatgaagtc

SEQ ID NO: 483994 - DNA, 15 bp, Homo sapiens
ttaacaatgaagtcc

SEQ ID NO: 483995 - DNA, 15 bp, Homo sapiens
taacaatgaagtccg

SEQ ID NO: 483996 - DNA, 15 bp, Homo sapiens
aacaatgaagtccgc

SEQ ID NO: 483997 - DNA, 15 bp, Homo sapiens
acaatgaagtccgcc

SEQ ID NO: 483998 - DNA, 15 bp, Homo sapiens
caatgaagtccgcct

SEQ ID NO: 483999 - DNA, 15 bp, Homo sapiens
aatgaagtccgcctc

SEQ ID NO: 484000 - DNA, 15 bp, Homo sapiens
atgaagtccgcctca

SEQ ID NO: 484001 - DNA, 15 bp, Homo sapiens
tgaagtccgcctcag

SEQ ID NO: 484002 - DNA, 15 bp, Homo sapiens
gaagtccgcctcagc

SEQ ID NO: 484003 - DNA, 15 bp, Homo sapiens
aagtccgcctcagct

SEQ ID NO: 484004 - DNA, 15 bp, Homo sapiens
agtccgcctcagctc

SEQ ID NO: 484005 - DNA, 15 bp, Homo sapiens
gtccgcctcagctct

SEQ ID NO: 484006 - DNA, 15 bp, Homo sapiens
tccgcctcagctctg

SEQ ID NO: 484007 - DNA, 15 bp, Homo sapiens
ccgcctcagctctga

SEQ ID NO: 484008 - DNA, 15 bp, Homo sapiens
cgcctcagctctgaa

SEQ ID NO: 484009 - DNA, 15 bp, Homo sapiens
gcctcagctctgaac

SEQ ID NO: 484010 - DNA, 15 bp, Homo sapiens
cctcagctctgaact

SEQ ID NO: 484011 - DNA, 15 bp, Homo sapiens
ctcagctctgaactg

SEQ ID NO: 484012 - DNA, 15 bp, Homo sapiens
tcagctctgaactgt

SEQ ID NO: 484013 - DNA, 15 bp, Homo sapiens
cagctctgaactgtt

SEQ ID NO: 484014 - DNA, 15 bp, Homo sapiens
agctctgaactgttt

SEQ ID NO: 484015 - DNA, 15 bp, Homo sapiens
gctctgaactgtttg

SEQ ID NO: 484016 - DNA, 15 bp, Homo sapiens
ctctgaactgtttga

SEQ ID NO: 484017 - DNA, 15 bp, Homo sapiens
tctgaactgtttgag

SEQ ID NO: 484018 - DNA, 15 bp, Homo sapiens
ctgaactgtttgaga

SEQ ID NO: 484019 - DNA, 15 bp, Homo sapiens
tgaactgtttgagag

SEQ ID NO: 484020 - DNA, 15 bp, Homo sapiens
gaactgtttgagaga

SEQ ID NO: 484021 - DNA, 15 bp, Homo sapiens
aactgtttgagagaa

SEQ ID NO: 484022 - DNA, 15 bp, Homo sapiens
actgtttgagagaaa

SEQ ID NO: 484023 - DNA, 15 bp, Homo sapiens
ctgtttgagagaaaa

SEQ ID NO: 484024 - DNA, 15 bp, Homo sapiens
tgtttgagagaaaat

SEQ ID NO: 484025 - DNA, 15 bp, Homo sapiens
gtttgagagaaaata

SEQ ID NO: 484026 - DNA, 15 bp, Homo sapiens
tttgagagaaaatat

SEQ ID NO: 484027 - DNA, 15 bp, Homo sapiens
ttgagagaaaatatc

SEQ ID NO: 484028 - DNA, 15 bp, Homo sapiens
tgagagaaaatatcc

SEQ ID NO: 484029 - DNA, 15 bp, Homo sapiens
gagagaaaatatcct

SEQ ID NO: 484030 - DNA, 15 bp, Homo sapiens
agagaaaatatccta

SEQ ID NO: 484031 - DNA, 15 bp, Homo sapiens
gagaaaatatcctat

SEQ ID NO: 484032 - DNA, 15 bp, Homo sapiens
agaaaatatcctatg

SEQ ID NO: 484033 - DNA, 15 bp, Homo sapiens
gaaaatatcctatga

SEQ ID NO: 484034 - DNA, 15 bp, Homo sapiens
aaaatatcctatgac

SEQ ID NO: 484035 - DNA, 15 bp, Homo sapiens
aaatatcctatgaca

SEQ ID NO: 484036 - DNA, 15 bp, Homo sapiens
aatatcctatgacat

SEQ ID NO: 484037 - DNA, 15 bp, Homo sapiens
atatcctatgacata

SEQ ID NO: 484038 - DNA, 15 bp, Homo sapiens
tatcctatgacatat

SEQ ID NO: 484039 - DNA, 15 bp, Homo sapiens
atcctatgacatata

SEQ ID NO: 484040 - DNA, 15 bp, Homo sapiens
tcctatgacatatat

SEQ ID NO: 484041 - DNA, 15 bp, Homo sapiens
cctatgacatatatc

SEQ ID NO: 484042 - DNA, 15 bp, Homo sapiens
ctatgacatatatct

SEQ ID NO: 484043 - DNA, 15 bp, Homo sapiens
tatgacatatatctt

SEQ ID NO: 484044 - DNA, 15 bp, Homo sapiens
atgacatatatcttc

SEQ ID NO: 484045 - DNA, 15 bp, Homo sapiens
tgacatatatcttcc

SEQ ID NO: 484046 - DNA, 15 bp, Homo sapiens
gacatatatcttcct

SEQ ID NO: 484047 - DNA, 15 bp, Homo sapiens
acatatatcttccta

SEQ ID NO: 484048 - DNA, 15 bp, Homo sapiens
catatatcttcctaa

SEQ ID NO: 484049 - DNA, 15 bp, Homo sapiens
atatatcttcctaaa

SEQ ID NO: 484050 - DNA, 15 bp, Homo sapiens
tatatcttcctaaat

SEQ ID NO: 484051 - DNA, 15 bp, Homo sapiens
atatcttcctaaatt

SEQ ID NO: 484052 - DNA, 15 bp, Homo sapiens
tatcttcctaaatta

SEQ ID NO: 484053 - DNA, 15 bp, Homo sapiens
atcttcctaaattat

SEQ ID NO: 484054 - DNA, 15 bp, Homo sapiens
tcttcctaaattata

SEQ ID NO: 484055 - DNA, 15 bp, Homo sapiens
cttcctaaattatac

SEQ ID NO: 484056 - DNA, 15 bp, Homo sapiens
ttcctaaattataca

SEQ ID NO: 484057 - DNA, 15 bp, Homo sapiens
tcctaaattatacat

SEQ ID NO: 484058 - DNA, 15 bp, Homo sapiens
cctaaattatacatg

SEQ ID NO: 484059 - DNA, 15 bp, Homo sapiens
ctaaattatacatgg

SEQ ID NO: 484060 - DNA, 15 bp, Homo sapiens
taaattatacatggg

SEQ ID NO: 484061 - DNA, 15 bp, Homo sapiens
aaattatacatggga

SEQ ID NO: 484062 - DNA, 15 bp, Homo sapiens
aattatacatgggaa

SEQ ID NO: 484063 - DNA, 15 bp, Homo sapiens
attatacatgggaag

SEQ ID NO: 484064 - DNA, 15 bp, Homo sapiens
ttatacatgggaagc

SEQ ID NO: 484065 - DNA, 15 bp, Homo sapiens
tatacatgggaagca

SEQ ID NO: 484066 - DNA, 15 bp, Homo sapiens
atacatgggaagcat

SEQ ID NO: 484067 - DNA, 15 bp, Homo sapiens
tacatgggaagcatc

SEQ ID NO: 484068 - DNA, 15 bp, Homo sapiens
acatgggaagcatct

SEQ ID NO: 484069 - DNA, 15 bp, Homo sapiens
catgggaagcatctg

SEQ ID NO: 484070 - DNA, 15 bp, Homo sapiens
atgggaagcatctgt

SEQ ID NO: 484071 - DNA, 15 bp, Homo sapiens
tgggaagcatctgta

SEQ ID NO: 484072 - DNA, 15 bp, Homo sapiens
gggaagcatctgtat

SEQ ID NO: 484073 - DNA, 15 bp, Homo sapiens
ggaagcatctgtatt

SEQ ID NO: 484074 - DNA, 15 bp, Homo sapiens
gaagcatctgtatta

SEQ ID NO: 484075 - DNA, 15 bp, Homo sapiens
aagcatctgtattaa

SEQ ID NO: 484076 - DNA, 15 bp, Homo sapiens
agcatctgtattaag

SEQ ID NO: 484077 - DNA, 15 bp, Homo sapiens
gcatctgtattaagg

SEQ ID NO: 484078 - DNA, 15 bp, Homo sapiens
catctgtattaagga

SEQ ID NO: 484079 - DNA, 15 bp, Homo sapiens
atctgtattaaggaa

SEQ ID NO: 484080 - DNA, 15 bp, Homo sapiens
tctgtattaaggaac

SEQ ID NO: 484081 - DNA, 15 bp, Homo sapiens
ctgtattaaggaaca

SEQ ID NO: 484082 - DNA, 15 bp, Homo sapiens
tgtattaaggaacag

SEQ ID NO: 484083 - DNA, 15 bp, Homo sapiens
gtattaaggaacagc

SEQ ID NO: 484084 - DNA, 15 bp, Homo sapiens
tattaaggaacagca

SEQ ID NO: 484085 - DNA, 15 bp, Homo sapiens
attaaggaacagcaa

SEQ ID NO: 484086 - DNA, 15 bp, Homo sapiens
ttaaggaacagcaag

SEQ ID NO: 484087 - DNA, 15 bp, Homo sapiens
taaggaacagcaaga

SEQ ID NO: 484088 - DNA, 15 bp, Homo sapiens
aaggaacagcaagag

SEQ ID NO: 484089 - DNA, 15 bp, Homo sapiens
aggaacagcaagaga

SEQ ID NO: 484090 - DNA, 15 bp, Homo sapiens
ggaacagcaagagac

SEQ ID NO: 484091 - DNA, 15 bp, Homo sapiens
gaacagcaagagacc

SEQ ID NO: 484092 - DNA, 15 bp, Homo sapiens
aacagcaagagacct

SEQ ID NO: 484093 - DNA, 15 bp, Homo sapiens
acagcaagagacctg

SEQ ID NO: 484094 - DNA, 15 bp, Homo sapiens
cagcaagagacctga

SEQ ID NO: 484095 - DNA, 15 bp, Homo sapiens
agcaagagacctgaa

SEQ ID NO: 484096 - DNA, 15 bp, Homo sapiens
gcaagagacctgaaa

SEQ ID NO: 484097 - DNA, 15 bp, Homo sapiens
caagagacctgaaat

SEQ ID NO: 484098 - DNA, 15 bp, Homo sapiens
aagagacctgaaatc

SEQ ID NO: 484099 - DNA, 15 bp, Homo sapiens
agagacctgaaatcg

SEQ ID NO: 484100 - DNA, 15 bp, Homo sapiens
gagacctgaaatcgg

SEQ ID NO: 484101 - DNA, 15 bp, Homo sapiens
agacctgaaatcggc

SEQ ID NO: 484102 - DNA, 15 bp, Homo sapiens
gacctgaaatcggca

SEQ ID NO: 484103 - DNA, 15 bp, Homo sapiens
acctgaaatcggcat

SEQ ID NO: 484104 - DNA, 15 bp, Homo sapiens
cctgaaatcggcatt

SEQ ID NO: 484105 - DNA, 15 bp, Homo sapiens
ctgaaatcggcattc

SEQ ID NO: 484106 - DNA, 15 bp, Homo sapiens
tgaaatcggcattct

SEQ ID NO: 484107 - DNA, 15 bp, Homo sapiens
gaaatcggcattcta

SEQ ID NO: 484108 - DNA, 15 bp, Homo sapiens
aaatcggcattctaa

SEQ ID NO: 484109 - DNA, 15 bp, Homo sapiens
aatcggcattctaaa

SEQ ID NO: 484110 - DNA, 15 bp, Homo sapiens
atcggcattctaaag

SEQ ID NO: 484111 - DNA, 15 bp, Homo sapiens
tcggcattctaaagc

SEQ ID NO: 484112 - DNA, 15 bp, Homo sapiens
cggcattctaaagct

SEQ ID NO: 484113 - DNA, 15 bp, Homo sapiens
ggcattctaaagctt

SEQ ID NO: 484114 - DNA, 15 bp, Homo sapiens
gcattctaaagcttt

SEQ ID NO: 484115 - DNA, 15 bp, Homo sapiens
cattctaaagctttc

SEQ ID NO: 484116 - DNA, 15 bp, Homo sapiens
attctaaagctttct

SEQ ID NO: 484117 - DNA, 15 bp, Homo sapiens
ttctaaagctttctt

SEQ ID NO: 484118 - DNA, 15 bp, Homo sapiens
tctaaagctttcttc

SEQ ID NO: 484119 - DNA, 15 bp, Homo sapiens
ctaaagctttcttcc

SEQ ID NO: 484120 - DNA, 15 bp, Homo sapiens
taaagctttcttcca

SEQ ID NO: 484121 - DNA, 15 bp, Homo sapiens
aaagctttcttccag

SEQ ID NO: 484122 - DNA, 15 bp, Homo sapiens
aagctttcttccagt

SEQ ID NO: 484123 - DNA, 15 bp, Homo sapiens
agctttcttccagtg

SEQ ID NO: 484124 - DNA, 15 bp, Homo sapiens
gctttcttccagtga

SEQ ID NO: 484125 - DNA, 15 bp, Homo sapiens
ctttcttccagtgag

SEQ ID NO: 484126 - DNA, 15 bp, Homo sapiens
tttcttccagtgaga

SEQ ID NO: 484127 - DNA, 15 bp, Homo sapiens
ttcttccagtgagac

SEQ ID NO: 484128 - DNA, 15 bp, Homo sapiens
tcttccagtgagaca

SEQ ID NO: 484129 - DNA, 15 bp, Homo sapiens
cttccagtgagacaa

SEQ ID NO: 484130 - DNA, 15 bp, Homo sapiens
ttccagtgagacaag

SEQ ID NO: 484131 - DNA, 15 bp, Homo sapiens
tccagtgagacaaga

SEQ ID NO: 484132 - DNA, 15 bp, Homo sapiens
ccagtgagacaagaa

SEQ ID NO: 484133 - DNA, 15 bp, Homo sapiens
cagtgagacaagaat

SEQ ID NO: 484134 - DNA, 15 bp, Homo sapiens
agtgagacaagaatg

SEQ ID NO: 484135 - DNA, 15 bp, Homo sapiens
gtgagacaagaatgc

SEQ ID NO: 484136 - DNA, 15 bp, Homo sapiens
tgagacaagaatgct

SEQ ID NO: 484137 - DNA, 15 bp, Homo sapiens
gagacaagaatgctg

SEQ ID NO: 484138 - DNA, 15 bp, Homo sapiens
agacaagaatgctga

SEQ ID NO: 484139 - DNA, 15 bp, Homo sapiens
gacaagaatgctgac

SEQ ID NO: 484140 - DNA, 15 bp, Homo sapiens
acaagaatgctgact

SEQ ID NO: 484141 - DNA, 15 bp, Homo sapiens
caagaatgctgactc

SEQ ID NO: 484142 - DNA, 15 bp, Homo sapiens
aagaatgctgactcc

SEQ ID NO: 484143 - DNA, 15 bp, Homo sapiens
agaatgctgactcca

SEQ ID NO: 484144 - DNA, 15 bp, Homo sapiens
gaatgctgactccaa

SEQ ID NO: 484145 - DNA, 15 bp, Homo sapiens
aatgctgactccaag

SEQ ID NO: 484146 - DNA, 15 bp, Homo sapiens
atgctgactccaaga

SEQ ID NO: 484147 - DNA, 15 bp, Homo sapiens
tgctgactccaagaa

SEQ ID NO: 484148 - DNA, 15 bp, Homo sapiens
gctgactccaagaat

SEQ ID NO: 484149 - DNA, 15 bp, Homo sapiens
ctgactccaagaatc

SEQ ID NO: 484150 - DNA, 15 bp, Homo sapiens
tgactccaagaatca

SEQ ID NO: 484151 - DNA, 15 bp, Homo sapiens
gactccaagaatcat

SEQ ID NO: 484152 - DNA, 15 bp, Homo sapiens
actccaagaatcatt

SEQ ID NO: 484153 - DNA, 15 bp, Homo sapiens
ctccaagaatcatta

SEQ ID NO: 484154 - DNA, 15 bp, Homo sapiens
tccaagaatcattat

SEQ ID NO: 484155 - DNA, 15 bp, Homo sapiens
ccaagaatcattatt

SEQ ID NO: 484156 - DNA, 15 bp, Homo sapiens
caagaatcattattt

SEQ ID NO: 484157 - DNA, 15 bp, Homo sapiens
aagaatcattatttt

SEQ ID NO: 484158 - DNA, 15 bp, Homo sapiens
agaatcattattttc

SEQ ID NO: 484159 - DNA, 15 bp, Homo sapiens
gaatcattattttct

SEQ ID NO: 484160 - DNA, 15 bp, Homo sapiens
aatcattattttcta

SEQ ID NO: 484161 - DNA, 15 bp, Homo sapiens
atcattattttctat

SEQ ID NO: 484162 - DNA, 15 bp, Homo sapiens
tcattattttctatt

SEQ ID NO: 484163 - DNA, 15 bp, Homo sapiens
cattattttctattc

SEQ ID NO: 484164 - DNA, 15 bp, Homo sapiens
attattttctattct

SEQ ID NO: 484165 - DNA, 15 bp, Homo sapiens
ttattttctattctc

SEQ ID NO: 484166 - DNA, 15 bp, Homo sapiens
tattttctattctca

SEQ ID NO: 484167 - DNA, 15 bp, Homo sapiens
attttctattctcaa

SEQ ID NO: 484168 - DNA, 15 bp, Homo sapiens
ttttctattctcaag

SEQ ID NO: 484169 - DNA, 15 bp, Homo sapiens
tttctattctcaaga

SEQ ID NO: 484170 - DNA, 15 bp, Homo sapiens
ttctattctcaagaa

SEQ ID NO: 484171 - DNA, 15 bp, Homo sapiens
tctattctcaagaaa

SEQ ID NO: 484172 - DNA, 15 bp, Homo sapiens
ctattctcaagaaat

SEQ ID NO: 484173 - DNA, 15 bp, Homo sapiens
tattctcaagaaatt

SEQ ID NO: 484174 - DNA, 15 bp, Homo sapiens
attctcaagaaattg

SEQ ID NO: 484175 - DNA, 15 bp, Homo sapiens
ttctcaagaaattga

SEQ ID NO: 484176 - DNA, 15 bp, Homo sapiens
tctcaagaaattgag

SEQ ID NO: 484177 - DNA, 15 bp, Homo sapiens
ctcaagaaattgagt

SEQ ID NO: 484178 - DNA, 15 bp, Homo sapiens
tcaagaaattgagtt

SEQ ID NO: 484179 - DNA, 15 bp, Homo sapiens
caagaaattgagtta

SEQ ID NO: 484180 - DNA, 15 bp, Homo sapiens
aagaaattgagttaa

SEQ ID NO: 484181 - DNA, 15 bp, Homo sapiens
agaaattgagttaaa

SEQ ID NO: 484182 - DNA, 15 bp, Homo sapiens
gaaattgagttaaag

SEQ ID NO: 484183 - DNA, 15 bp, Homo sapiens
aaattgagttaaaga

SEQ ID NO: 484184 - DNA, 15 bp, Homo sapiens
aattgagttaaagat

SEQ ID NO: 484185 - DNA, 15 bp, Homo sapiens
attgagttaaagatg

SEQ ID NO: 484186 - DNA, 15 bp, Homo sapiens
ttgagttaaagatgg

SEQ ID NO: 484187 - DNA, 15 bp, Homo sapiens
tgagttaaagatggt

SEQ ID NO: 484188 - DNA, 15 bp, Homo sapiens
gagttaaagatggtt

SEQ ID NO: 484189 - DNA, 15 bp, Homo sapiens
agttaaagatggtta

SEQ ID NO: 484190 - DNA, 15 bp, Homo sapiens
gttaaagatggttat

SEQ ID NO: 484191 - DNA, 15 bp, Homo sapiens
ttaaagatggttatt

SEQ ID NO: 484192 - DNA, 15 bp, Homo sapiens
taaagatggttatta

SEQ ID NO: 484193 - DNA, 15 bp, Homo sapiens
aaagatggttattaa

SEQ ID NO: 484194 - DNA, 15 bp, Homo sapiens
aagatggttattaat

SEQ ID NO: 484195 - DNA, 15 bp, Homo sapiens
agatggttattaatt

SEQ ID NO: 484196 - DNA, 15 bp, Homo sapiens
gatggttattaattt

SEQ ID NO: 484197 - DNA, 15 bp, Homo sapiens
atggttattaatttg

SEQ ID NO: 484198 - DNA, 15 bp, Homo sapiens
tggttattaatttgc

SEQ ID NO: 484199 - DNA, 15 bp, Homo sapiens
ggttattaatttgct

SEQ ID NO: 484200 - DNA, 15 bp, Homo sapiens
gttattaatttgcta

SEQ ID NO: 484201 - DNA, 15 bp, Homo sapiens
ttattaatttgctac

SEQ ID NO: 484202 - DNA, 15 bp, Homo sapiens
tattaatttgctact

SEQ ID NO: 484203 - DNA, 15 bp, Homo sapiens
attaatttgctacta

SEQ ID NO: 484204 - DNA, 15 bp, Homo sapiens
ttaatttgctactat

SEQ ID NO: 484205 - DNA, 15 bp, Homo sapiens
taatttgctactatt

SEQ ID NO: 484206 - DNA, 15 bp, Homo sapiens
aatttgctactatta

SEQ ID NO: 484207 - DNA, 15 bp, Homo sapiens
atttgctactattat

SEQ ID NO: 484208 - DNA, 15 bp, Homo sapiens
tttgctactattatt

SEQ ID NO: 484209 - DNA, 15 bp, Homo sapiens
ttgctactattattt

SEQ ID NO: 484210 - DNA, 15 bp, Homo sapiens
tgctactattatttc

SEQ ID NO: 484211 - DNA, 15 bp, Homo sapiens
gctactattatttcc

SEQ ID NO: 484212 - DNA, 15 bp, Homo sapiens
ctactattatttcct

SEQ ID NO: 484213 - DNA, 15 bp, Homo sapiens
tactattatttccta

SEQ ID NO: 484214 - DNA, 15 bp, Homo sapiens
actattatttcctaa

SEQ ID NO: 484215 - DNA, 15 bp, Homo sapiens
ctattatttcctaac

SEQ ID NO: 484216 - DNA, 15 bp, Homo sapiens
tattatttcctaaca

SEQ ID NO: 484217 - DNA, 15 bp, Homo sapiens
attatttcctaacac

SEQ ID NO: 484218 - DNA, 15 bp, Homo sapiens
ttatttcctaacact

SEQ ID NO: 484219 - DNA, 15 bp, Homo sapiens
tatttcctaacactg

SEQ ID NO: 484220 - DNA, 15 bp, Homo sapiens
atttcctaacactgg

SEQ ID NO: 484221 - DNA, 15 bp, Homo sapiens
tttcctaacactgga

SEQ ID NO: 484222 - DNA, 15 bp, Homo sapiens
ttcctaacactggac

SEQ ID NO: 484223 - DNA, 15 bp, Homo sapiens
tcctaacactggacc

SEQ ID NO: 484224 - DNA, 15 bp, Homo sapiens
cctaacactggacca

SEQ ID NO: 484225 - DNA, 15 bp, Homo sapiens
ctaacactggaccat

SEQ ID NO: 484226 - DNA, 15 bp, Homo sapiens
taacactggaccatg

SEQ ID NO: 484227 - DNA, 15 bp, Homo sapiens
aacactggaccatgt

SEQ ID NO: 484228 - DNA, 15 bp, Homo sapiens
acactggaccatgtt

SEQ ID NO: 484229 - DNA, 15 bp, Homo sapiens
cactggaccatgttt

SEQ ID NO: 484230 - DNA, 15 bp, Homo sapiens
actggaccatgtttt

SEQ ID NO: 484231 - DNA, 15 bp, Homo sapiens
ctggaccatgtttta

SEQ ID NO: 484232 - DNA, 15 bp, Homo sapiens
tggaccatgttttat

SEQ ID NO: 484233 - DNA, 15 bp, Homo sapiens
ggaccatgttttatg

SEQ ID NO: 484234 - DNA, 15 bp, Homo sapiens
gaccatgttttatgg

SEQ ID NO: 484235 - DNA, 15 bp, Homo sapiens
accatgttttatggg

SEQ ID NO: 484236 - DNA, 15 bp, Homo sapiens
ccatgttttatggga

SEQ ID NO: 484237 - DNA, 15 bp, Homo sapiens
catgttttatgggag

SEQ ID NO: 484238 - DNA, 15 bp, Homo sapiens
atgttttatgggagt

SEQ ID NO: 484239 - DNA, 15 bp, Homo sapiens
tgttttatgggagtt

SEQ ID NO: 484240 - DNA, 15 bp, Homo sapiens
gttttatgggagttg

SEQ ID NO: 484241 - DNA, 15 bp, Homo sapiens
ttttatgggagttgc

SEQ ID NO: 484242 - DNA, 15 bp, Homo sapiens
tttatgggagttgct

SEQ ID NO: 484243 - DNA, 15 bp, Homo sapiens
ttatgggagttgctt

SEQ ID NO: 484244 - DNA, 15 bp, Homo sapiens
tatgggagttgcttg

SEQ ID NO: 484245 - DNA, 15 bp, Homo sapiens
atgggagttgcttgc

SEQ ID NO: 484246 - DNA, 15 bp, Homo sapiens
tgggagttgcttgca

SEQ ID NO: 484247 - DNA, 15 bp, Homo sapiens
gggagttgcttgcaa

SEQ ID NO: 484248 - DNA, 15 bp, Homo sapiens
ggagttgcttgcaag

SEQ ID NO: 484249 - DNA, 15 bp, Homo sapiens
gagttgcttgcaagc

SEQ ID NO: 484250 - DNA, 15 bp, Homo sapiens
agttgcttgcaagct

SEQ ID NO: 484251 - DNA, 15 bp, Homo sapiens
gttgcttgcaagctt

SEQ ID NO: 484252 - DNA, 15 bp, Homo sapiens
ttgcttgcaagcttt

SEQ ID NO: 484253 - DNA, 15 bp, Homo sapiens
tgcttgcaagctttc

SEQ ID NO: 484254 - DNA, 15 bp, Homo sapiens
gcttgcaagctttct

SEQ ID NO: 484255 - DNA, 15 bp, Homo sapiens
cttgcaagctttctg

SEQ ID NO: 484256 - DNA, 15 bp, Homo sapiens
ttgcaagctttctgg

SEQ ID NO: 484257 - DNA, 15 bp, Homo sapiens
tgcaagctttctgga

SEQ ID NO: 484258 - DNA, 15 bp, Homo sapiens
gcaagctttctggat

SEQ ID NO: 484259 - DNA, 15 bp, Homo sapiens
caagctttctggatg

SEQ ID NO: 484260 - DNA, 15 bp, Homo sapiens
aagctttctggatga

SEQ ID NO: 484261 - DNA, 15 bp, Homo sapiens
agctttctggatgat

SEQ ID NO: 484262 - DNA, 15 bp, Homo sapiens
gctttctggatgata

SEQ ID NO: 484263 - DNA, 15 bp, Homo sapiens
ctttctggatgataa

SEQ ID NO: 484264 - DNA, 15 bp, Homo sapiens
tttctggatgataag

SEQ ID NO: 484265 - DNA, 15 bp, Homo sapiens
ttctggatgataaga

SEQ ID NO: 484266 - DNA, 15 bp, Homo sapiens
tctggatgataagaa

SEQ ID NO: 484267 - DNA, 15 bp, Homo sapiens
ctggatgataagaaa

SEQ ID NO: 484268 - DNA, 15 bp, Homo sapiens
tggatgataagaaat

SEQ ID NO: 484269 - DNA, 15 bp, Homo sapiens
ggatgataagaaata

SEQ ID NO: 484270 - DNA, 15 bp, Homo sapiens
gatgataagaaatac

SEQ ID NO: 484271 - DNA, 15 bp, Homo sapiens
atgataagaaataca

SEQ ID NO: 484272 - DNA, 15 bp, Homo sapiens
tgataagaaatacaa

SEQ ID NO: 484273 - DNA, 15 bp, Homo sapiens
gataagaaatacaat

SEQ ID NO: 484274 - DNA, 15 bp, Homo sapiens
ataagaaatacaatt

SEQ ID NO: 484275 - DNA, 15 bp, Homo sapiens
taagaaatacaattt

SEQ ID NO: 484276 - DNA, 15 bp, Homo sapiens
aagaaatacaattta

SEQ ID NO: 484277 - DNA, 15 bp, Homo sapiens
agaaatacaatttac

SEQ ID NO: 484278 - DNA, 15 bp, Homo sapiens
gaaatacaatttaca

SEQ ID NO: 484279 - DNA, 15 bp, Homo sapiens
aaatacaatttacat

SEQ ID NO: 484280 - DNA, 15 bp, Homo sapiens
aatacaatttacatt

SEQ ID NO: 484281 - DNA, 15 bp, Homo sapiens
atacaatttacatta

SEQ ID NO: 484282 - DNA, 15 bp, Homo sapiens
tacaatttacattaa

SEQ ID NO: 484283 - DNA, 15 bp, Homo sapiens
acaatttacattaag

SEQ ID NO: 484284 - DNA, 15 bp, Homo sapiens
caatttacattaaga

SEQ ID NO: 484285 - DNA, 15 bp, Homo sapiens
aatttacattaagat

SEQ ID NO: 484286 - DNA, 15 bp, Homo sapiens
atttacattaagatg

SEQ ID NO: 484287 - DNA, 15 bp, Homo sapiens
tttacattaagatga

SEQ ID NO: 484288 - DNA, 15 bp, Homo sapiens
ttacattaagatgaa

SEQ ID NO: 484289 - DNA, 15 bp, Homo sapiens
tacattaagatgaat

SEQ ID NO: 484290 - DNA, 15 bp, Homo sapiens
acattaagatgaata

SEQ ID NO: 484291 - DNA, 15 bp, Homo sapiens
cattaagatgaatac

SEQ ID NO: 484292 - DNA, 15 bp, Homo sapiens
attaagatgaataca

SEQ ID NO: 484293 - DNA, 15 bp, Homo sapiens
ttaagatgaatacat

SEQ ID NO: 484294 - DNA, 15 bp, Homo sapiens
taagatgaatacatg

SEQ ID NO: 484295 - DNA, 15 bp, Homo sapiens
aagatgaatacatgc

SEQ ID NO: 484296 - DNA, 15 bp, Homo sapiens
agatgaatacatgca

SEQ ID NO: 484297 - DNA, 15 bp, Homo sapiens
gatgaatacatgcat

SEQ ID NO: 484298 - DNA, 15 bp, Homo sapiens
atgaatacatgcatg

SEQ ID NO: 484299 - DNA, 15 bp, Homo sapiens
tgaatacatgcatgt

SEQ ID NO: 484300 - DNA, 15 bp, Homo sapiens
gaatacatgcatgta

SEQ ID NO: 484301 - DNA, 15 bp, Homo sapiens
aatacatgcatgtat

SEQ ID NO: 484302 - DNA, 15 bp, Homo sapiens
atacatgcatgtatg

SEQ ID NO: 484303 - DNA, 15 bp, Homo sapiens
tacatgcatgtatgg

SEQ ID NO: 484304 - DNA, 15 bp, Homo sapiens
acatgcatgtatgga

SEQ ID NO: 484305 - DNA, 15 bp, Homo sapiens
catgcatgtatggag

SEQ ID NO: 484306 - DNA, 15 bp, Homo sapiens
atgcatgtatggaga

SEQ ID NO: 484307 - DNA, 15 bp, Homo sapiens
tgcatgtatggagaa

SEQ ID NO: 484308 - DNA, 15 bp, Homo sapiens
gcatgtatggagaat

SEQ ID NO: 484309 - DNA, 15 bp, Homo sapiens
catgtatggagaata

SEQ ID NO: 484310 - DNA, 15 bp, Homo sapiens
atgtatggagaatac

SEQ ID NO: 484311 - DNA, 15 bp, Homo sapiens
tgtatggagaataca

SEQ ID NO: 484312 - DNA, 15 bp, Homo sapiens
gtatggagaatacaa

SEQ ID NO: 484313 - DNA, 15 bp, Homo sapiens
tatggagaatacaaa

SEQ ID NO: 484314 - DNA, 15 bp, Homo sapiens
tggagaatacaaaat

SEQ ID NO: 484315 - DNA, 15 bp, Homo sapiens
ggagaatacaaaata

SEQ ID NO: 484316 - DNA, 15 bp, Homo sapiens
gagaatacaaaataa

SEQ ID NO: 484317 - DNA, 15 bp, Homo sapiens
agaatacaaaataat

SEQ ID NO: 484318 - DNA, 15 bp, Homo sapiens
gaatacaaaataata

SEQ ID NO: 484319 - DNA, 15 bp, Homo sapiens
aatacaaaataatac

SEQ ID NO: 484320 - DNA, 15 bp, Homo sapiens
atacaaaataatact

SEQ ID NO: 484321 - DNA, 15 bp, Homo sapiens
tacaaaataatactt

SEQ ID NO: 484322 - DNA, 15 bp, Homo sapiens
acaaaataatacttg

SEQ ID NO: 484323 - DNA, 15 bp, Homo sapiens
caaaataatacttgc

SEQ ID NO: 484324 - DNA, 15 bp, Homo sapiens
aaaataatacttgcc

SEQ ID NO: 484325 - DNA, 15 bp, Homo sapiens
aaataatacttgcct

SEQ ID NO: 484326 - DNA, 15 bp, Homo sapiens
aataatacttgcctt

SEQ ID NO: 484327 - DNA, 15 bp, Homo sapiens
ataatacttgccttt

SEQ ID NO: 484328 - DNA, 15 bp, Homo sapiens
taatacttgccttta

SEQ ID NO: 484329 - DNA, 15 bp, Homo sapiens
aatacttgcctttat

SEQ ID NO: 484330 - DNA, 15 bp, Homo sapiens
atacttgcctttata

SEQ ID NO: 484331 - DNA, 15 bp, Homo sapiens
tacttgcctttatag

SEQ ID NO: 484332 - DNA, 15 bp, Homo sapiens
acttgcctttataga

SEQ ID NO: 484333 - DNA, 15 bp, Homo sapiens
cttgcctttatagag

SEQ ID NO: 484334 - DNA, 15 bp, Homo sapiens
ttgcctttatagaga

SEQ ID NO: 484335 - DNA, 15 bp, Homo sapiens
tgcctttatagagaa

SEQ ID NO: 484336 - DNA, 15 bp, Homo sapiens
gcctttatagagaaa

SEQ ID NO: 484337 - DNA, 15 bp, Homo sapiens
cctttatagagaaat

SEQ ID NO: 484338 - DNA, 15 bp, Homo sapiens
ctttatagagaaatg

SEQ ID NO: 484339 - DNA, 15 bp, Homo sapiens
tttatagagaaatgc

SEQ ID NO: 484340 - DNA, 15 bp, Homo sapiens
ttatagagaaatgcc

SEQ ID NO: 484341 - DNA, 15 bp, Homo sapiens
tatagagaaatgcca

SEQ ID NO: 484342 - DNA, 15 bp, Homo sapiens
atagagaaatgccag

SEQ ID NO: 484343 - DNA, 15 bp, Homo sapiens
tagagaaatgccagc

SEQ ID NO: 484344 - DNA, 15 bp, Homo sapiens
agagaaatgccagct

SEQ ID NO: 484345 - DNA, 15 bp, Homo sapiens
gagaaatgccagctc

SEQ ID NO: 484346 - DNA, 15 bp, Homo sapiens
agaaatgccagctct

SEQ ID NO: 484347 - DNA, 15 bp, Homo sapiens
gaaatgccagctctt

SEQ ID NO: 484348 - DNA, 15 bp, Homo sapiens
aaatgccagctctta

SEQ ID NO: 484349 - DNA, 15 bp, Homo sapiens
aatgccagctcttat

SEQ ID NO: 484350 - DNA, 15 bp, Homo sapiens
atgccagctcttatt

SEQ ID NO: 484351 - DNA, 15 bp, Homo sapiens
tgccagctcttattt

SEQ ID NO: 484352 - DNA, 15 bp, Homo sapiens
gccagctcttatttt

SEQ ID NO: 484353 - DNA, 15 bp, Homo sapiens
ccagctcttattttc

SEQ ID NO: 484354 - DNA, 15 bp, Homo sapiens
cagctcttattttct

SEQ ID NO: 484355 - DNA, 15 bp, Homo sapiens
agctcttattttcta

SEQ ID NO: 484356 - DNA, 15 bp, Homo sapiens
gctcttattttctat

SEQ ID NO: 484357 - DNA, 15 bp, Homo sapiens
ctcttattttctatt

SEQ ID NO: 484358 - DNA, 15 bp, Homo sapiens
tcttattttctattt

SEQ ID NO: 484359 - DNA, 15 bp, Homo sapiens
cttattttctatttt

SEQ ID NO: 484360 - DNA, 15 bp, Homo sapiens
ttattttctattttc

SEQ ID NO: 484361 - DNA, 15 bp, Homo sapiens
tattttctattttcc

SEQ ID NO: 484362 - DNA, 15 bp, Homo sapiens
attttctattttccc

SEQ ID NO: 484363 - DNA, 15 bp, Homo sapiens
ttttctattttccct

SEQ ID NO: 484364 - DNA, 15 bp, Homo sapiens
tttctattttccctt

SEQ ID NO: 484365 - DNA, 15 bp, Homo sapiens
ttctattttcccttt

SEQ ID NO: 484366 - DNA, 15 bp, Homo sapiens
tctattttccctttc

SEQ ID NO: 484367 - DNA, 15 bp, Homo sapiens
ctattttccctttct

SEQ ID NO: 484368 - DNA, 15 bp, Homo sapiens
tattttccctttctt

SEQ ID NO: 484369 - DNA, 15 bp, Homo sapiens
attttccctttcttc

SEQ ID NO: 484370 - DNA, 15 bp, Homo sapiens
ttttccctttcttcc

SEQ ID NO: 484371 - DNA, 15 bp, Homo sapiens
tttccctttcttcct

SEQ ID NO: 484372 - DNA, 15 bp, Homo sapiens
ttccctttcttcctc

SEQ ID NO: 484373 - DNA, 15 bp, Homo sapiens
tccctttcttcctcc

SEQ ID NO: 484374 - DNA, 15 bp, Homo sapiens
ccctttcttcctccc

SEQ ID NO: 484375 - DNA, 15 bp, Homo sapiens
cctttcttcctccct

SEQ ID NO: 484376 - DNA, 15 bp, Homo sapiens
ctttcttcctccctc

SEQ ID NO: 484377 - DNA, 15 bp, Homo sapiens
tttcttcctccctcc

SEQ ID NO: 484378 - DNA, 15 bp, Homo sapiens
ttcttcctccctccc

SEQ ID NO: 484379 - DNA, 15 bp, Homo sapiens
tcttcctccctccct

SEQ ID NO: 484380 - DNA, 15 bp, Homo sapiens
cttcctccctccctt

SEQ ID NO: 484381 - DNA, 15 bp, Homo sapiens
ttcctccctcccttt

SEQ ID NO: 484382 - DNA, 15 bp, Homo sapiens
tcctccctccctttc

SEQ ID NO: 484383 - DNA, 15 bp, Homo sapiens
cctccctccctttct

SEQ ID NO: 484384 - DNA, 15 bp, Homo sapiens
ctccctccctttctt

SEQ ID NO: 484385 - DNA, 15 bp, Homo sapiens
tccctccctttcttc

SEQ ID NO: 484386 - DNA, 15 bp, Homo sapiens
ccctccctttcttcc

SEQ ID NO: 484387 - DNA, 15 bp, Homo sapiens
cctccctttcttcct

SEQ ID NO: 484388 - DNA, 15 bp, Homo sapiens
ctccctttcttcctt

SEQ ID NO: 484389 - DNA, 15 bp, Homo sapiens
tccctttcttccttc

SEQ ID NO: 484390 - DNA, 15 bp, Homo sapiens
ccctttcttccttct

SEQ ID NO: 484391 - DNA, 15 bp, Homo sapiens
cctttcttccttctg

SEQ ID NO: 484392 - DNA, 15 bp, Homo sapiens
ctttcttccttctgt

SEQ ID NO: 484393 - DNA, 15 bp, Homo sapiens
tttcttccttctgtt

SEQ ID NO: 484394 - DNA, 15 bp, Homo sapiens
ttcttccttctgttt

SEQ ID NO: 484395 - DNA, 15 bp, Homo sapiens
tcttccttctgtttt

SEQ ID NO: 484396 - DNA, 15 bp, Homo sapiens
cttccttctgttttt

SEQ ID NO: 484397 - DNA, 15 bp, Homo sapiens
ttccttctgtttttc

SEQ ID NO: 484398 - DNA, 15 bp, Homo sapiens
tccttctgtttttct

SEQ ID NO: 484399 - DNA, 15 bp, Homo sapiens
ccttctgtttttctt

SEQ ID NO: 484400 - DNA, 15 bp, Homo sapiens
cttctgtttttcttt

SEQ ID NO: 484401 - DNA, 15 bp, Homo sapiens
ttctgtttttctttc

SEQ ID NO: 484402 - DNA, 15 bp, Homo sapiens
tctgtttttctttct

SEQ ID NO: 484403 - DNA, 15 bp, Homo sapiens
ctgtttttctttctt

SEQ ID NO: 484404 - DNA, 15 bp, Homo sapiens
tgtttttctttctta

SEQ ID NO: 484405 - DNA, 15 bp, Homo sapiens
gtttttctttcttaa

SEQ ID NO: 484406 - DNA, 15 bp, Homo sapiens
tttttctttcttaat

SEQ ID NO: 484407 - DNA, 15 bp, Homo sapiens
ttttctttcttaatg

SEQ ID NO: 484408 - DNA, 15 bp, Homo sapiens
tttctttcttaatgc

SEQ ID NO: 484409 - DNA, 15 bp, Homo sapiens
ttctttcttaatgct

SEQ ID NO: 484410 - DNA, 15 bp, Homo sapiens
tctttcttaatgctg

SEQ ID NO: 484411 - DNA, 15 bp, Homo sapiens
ctttcttaatgctgg

SEQ ID NO: 484412 - DNA, 15 bp, Homo sapiens
tttcttaatgctggt

SEQ ID NO: 484413 - DNA, 15 bp, Homo sapiens
ttcttaatgctggtc

SEQ ID NO: 484414 - DNA, 15 bp, Homo sapiens
tcttaatgctggtca

SEQ ID NO: 484415 - DNA, 15 bp, Homo sapiens
cttaatgctggtcag

SEQ ID NO: 484416 - DNA, 15 bp, Homo sapiens
ttaatgctggtcagg

SEQ ID NO: 484417 - DNA, 15 bp, Homo sapiens
taatgctggtcagga

SEQ ID NO: 484418 - DNA, 15 bp, Homo sapiens
aatgctggtcaggac

SEQ ID NO: 484419 - DNA, 15 bp, Homo sapiens
atgctggtcaggacc

SEQ ID NO: 484420 - DNA, 15 bp, Homo sapiens
tgctggtcaggacct

SEQ ID NO: 484421 - DNA, 15 bp, Homo sapiens
gctggtcaggaccta

SEQ ID NO: 484422 - DNA, 15 bp, Homo sapiens
ctggtcaggacctac

SEQ ID NO: 484423 - DNA, 15 bp, Homo sapiens
tggtcaggacctact

SEQ ID NO: 484424 - DNA, 15 bp, Homo sapiens
ggtcaggacctacta

SEQ ID NO: 484425 - DNA, 15 bp, Homo sapiens
gtcaggacctactaa

SEQ ID NO: 484426 - DNA, 15 bp, Homo sapiens
tcaggacctactaaa

SEQ ID NO: 484427 - DNA, 15 bp, Homo sapiens
caggacctactaaat

SEQ ID NO: 484428 - DNA, 15 bp, Homo sapiens
aggacctactaaatt

SEQ ID NO: 484429 - DNA, 15 bp, Homo sapiens
ggacctactaaattg

SEQ ID NO: 484430 - DNA, 15 bp, Homo sapiens
gacctactaaattga

SEQ ID NO: 484431 - DNA, 15 bp, Homo sapiens
acctactaaattgat

SEQ ID NO: 484432 - DNA, 15 bp, Homo sapiens
cctactaaattgatt

SEQ ID NO: 484433 - DNA, 15 bp, Homo sapiens
ctactaaattgattc

SEQ ID NO: 484434 - DNA, 15 bp, Homo sapiens
tactaaattgattct

SEQ ID NO: 484435 - DNA, 15 bp, Homo sapiens
actaaattgattcta

SEQ ID NO: 484436 - DNA, 15 bp, Homo sapiens
ctaaattgattctat

SEQ ID NO: 484437 - DNA, 15 bp, Homo sapiens
taaattgattctata

SEQ ID NO: 484438 - DNA, 15 bp, Homo sapiens
aaattgattctataa

SEQ ID NO: 484439 - DNA, 15 bp, Homo sapiens
aattgattctataac

SEQ ID NO: 484440 - DNA, 15 bp, Homo sapiens
attgattctataact

SEQ ID NO: 484441 - DNA, 15 bp, Homo sapiens
ttgattctataactc

SEQ ID NO: 484442 - DNA, 15 bp, Homo sapiens
tgattctataactca

SEQ ID NO: 484443 - DNA, 15 bp, Homo sapiens
gattctataactcat

SEQ ID NO: 484444 - DNA, 15 bp, Homo sapiens
attctataactcatc

SEQ ID NO: 484445 - DNA, 15 bp, Homo sapiens
ttctataactcatcg

SEQ ID NO: 484446 - DNA, 15 bp, Homo sapiens
tctataactcatcgg

SEQ ID NO: 484447 - DNA, 15 bp, Homo sapiens
ctataactcatcggt

SEQ ID NO: 484448 - DNA, 15 bp, Homo sapiens
tataactcatcggtg

SEQ ID NO: 484449 - DNA, 15 bp, Homo sapiens
ataactcatcggtgg

SEQ ID NO: 484450 - DNA, 15 bp, Homo sapiens
taactcatcggtggg

SEQ ID NO: 484451 - DNA, 15 bp, Homo sapiens
aactcatcggtgggt

SEQ ID NO: 484452 - DNA, 15 bp, Homo sapiens
actcatcggtgggtt

SEQ ID NO: 484453 - DNA, 15 bp, Homo sapiens
ctcatcggtgggtta

SEQ ID NO: 484454 - DNA, 15 bp, Homo sapiens
tcatcggtgggttat

SEQ ID NO: 484455 - DNA, 15 bp, Homo sapiens
catcggtgggttatt

SEQ ID NO: 484456 - DNA, 15 bp, Homo sapiens
atcggtgggttattg

SEQ ID NO: 484457 - DNA, 15 bp, Homo sapiens
tcggtgggttattgc

SEQ ID NO: 484458 - DNA, 15 bp, Homo sapiens
cggtgggttattgca

SEQ ID NO: 484459 - DNA, 15 bp, Homo sapiens
ggtgggttattgcat

SEQ ID NO: 484460 - DNA, 15 bp, Homo sapiens
gtgggttattgcatt

SEQ ID NO: 484461 - DNA, 15 bp, Homo sapiens
tgggttattgcattc

SEQ ID NO: 484462 - DNA, 15 bp, Homo sapiens
gggttattgcattca

SEQ ID NO: 484463 - DNA, 15 bp, Homo sapiens
ggttattgcattcag

SEQ ID NO: 484464 - DNA, 15 bp, Homo sapiens
gttattgcattcagt

SEQ ID NO: 484465 - DNA, 15 bp, Homo sapiens
ttattgcattcagtt

SEQ ID NO: 484466 - DNA, 15 bp, Homo sapiens
tattgcattcagttt

SEQ ID NO: 484467 - DNA, 15 bp, Homo sapiens
ttgcattcagttttg

SEQ ID NO: 484468 - DNA, 15 bp, Homo sapiens
tgcattcagttttga

SEQ ID NO: 484469 - DNA, 15 bp, Homo sapiens
gcattcagttttgaa

SEQ ID NO: 484470 - DNA, 15 bp, Homo sapiens
cattcagttttgaaa

SEQ ID NO: 484471 - DNA, 15 bp, Homo sapiens
attcagttttgaaaa

SEQ ID NO: 484472 - DNA, 15 bp, Homo sapiens
ttcagttttgaaaaa

SEQ ID NO: 484473 - DNA, 15 bp, Homo sapiens
tcagttttgaaaaac

SEQ ID NO: 484474 - DNA, 15 bp, Homo sapiens
cagttttgaaaaaca

SEQ ID NO: 484475 - DNA, 15 bp, Homo sapiens
agttttgaaaaacac

SEQ ID NO: 484476 - DNA, 15 bp, Homo sapiens
gttttgaaaaacact

SEQ ID NO: 484477 - DNA, 15 bp, Homo sapiens
ttttgaaaaacactg

SEQ ID NO: 484478 - DNA, 15 bp, Homo sapiens
tttgaaaaacactgt

SEQ ID NO: 484479 - DNA, 15 bp, Homo sapiens
ttgaaaaacactgtt

SEQ ID NO: 484480 - DNA, 15 bp, Homo sapiens
tgaaaaacactgttc

SEQ ID NO: 484481 - DNA, 15 bp, Homo sapiens
gaaaaacactgttct

SEQ ID NO: 484482 - DNA, 15 bp, Homo sapiens
aaaaacactgttctt

SEQ ID NO: 484483 - DNA, 15 bp, Homo sapiens
aaaacactgttcttt

SEQ ID NO: 484484 - DNA, 15 bp, Homo sapiens
aaacactgttctttg

SEQ ID NO: 484485 - DNA, 15 bp, Homo sapiens
aacactgttctttga

SEQ ID NO: 484486 - DNA, 15 bp, Homo sapiens
acactgttctttgag

SEQ ID NO: 484487 - DNA, 15 bp, Homo sapiens
cactgttctttgaga

SEQ ID NO: 484488 - DNA, 15 bp, Homo sapiens
actgttctttgagat

SEQ ID NO: 484489 - DNA, 15 bp, Homo sapiens
ctgttctttgagata

SEQ ID NO: 484490 - DNA, 15 bp, Homo sapiens
tgttctttgagatat

SEQ ID NO: 484491 - DNA, 15 bp, Homo sapiens
gttctttgagatata

SEQ ID NO: 484492 - DNA, 15 bp, Homo sapiens
ttctttgagatataa

SEQ ID NO: 484493 - DNA, 15 bp, Homo sapiens
tctttgagatataaa

SEQ ID NO: 484494 - DNA, 15 bp, Homo sapiens
ctttgagatataaaa

SEQ ID NO: 484495 - DNA, 15 bp, Homo sapiens
tttgagatataaaag

SEQ ID NO: 484496 - DNA, 15 bp, Homo sapiens
ttgagatataaaaga

SEQ ID NO: 484497 - DNA, 15 bp, Homo sapiens
tgagatataaaagaa

SEQ ID NO: 484498 - DNA, 15 bp, Homo sapiens
gagatataaaagaag

SEQ ID NO: 484499 - DNA, 15 bp, Homo sapiens
agatataaaagaagc

SEQ ID NO: 484500 - DNA, 15 bp, Homo sapiens
gatataaaagaagca

SEQ ID NO: 484501 - DNA, 15 bp, Homo sapiens
atataaaagaagcat

SEQ ID NO: 484502 - DNA, 15 bp, Homo sapiens
tataaaagaagcatc

SEQ ID NO: 484503 - DNA, 15 bp, Homo sapiens
ataaaagaagcatca

SEQ ID NO: 484504 - DNA, 15 bp, Homo sapiens
taaaagaagcatcaa

SEQ ID NO: 484505 - DNA, 15 bp, Homo sapiens
aaaagaagcatcaat

SEQ ID NO: 484506 - DNA, 15 bp, Homo sapiens
aaagaagcatcaata

SEQ ID NO: 484507 - DNA, 15 bp, Homo sapiens
aagaagcatcaatac

SEQ ID NO: 484508 - DNA, 15 bp, Homo sapiens
agaagcatcaataca

SEQ ID NO: 484509 - DNA, 15 bp, Homo sapiens
gaagcatcaatacag

SEQ ID NO: 484510 - DNA, 15 bp, Homo sapiens
aagcatcaatacagt

SEQ ID NO: 484511 - DNA, 15 bp, Homo sapiens
agcatcaatacagtt

SEQ ID NO: 484512 - DNA, 15 bp, Homo sapiens
gcatcaatacagttt

SEQ ID NO: 484513 - DNA, 15 bp, Homo sapiens
catcaatacagtttc

SEQ ID NO: 484514 - DNA, 15 bp, Homo sapiens
atcaatacagtttct

SEQ ID NO: 484515 - DNA, 15 bp, Homo sapiens
tcaatacagtttctg

SEQ ID NO: 484516 - DNA, 15 bp, Homo sapiens
caatacagtttctgc

SEQ ID NO: 484517 - DNA, 15 bp, Homo sapiens
aatacagtttctgcc

SEQ ID NO: 484518 - DNA, 15 bp, Homo sapiens
atacagtttctgcct

SEQ ID NO: 484519 - DNA, 15 bp, Homo sapiens
tacagtttctgcctt

SEQ ID NO: 484520 - DNA, 15 bp, Homo sapiens
acagtttctgccttt

SEQ ID NO: 484521 - DNA, 15 bp, Homo sapiens
cagtttctgcctttc

SEQ ID NO: 484522 - DNA, 15 bp, Homo sapiens
agtttctgcctttct

SEQ ID NO: 484523 - DNA, 15 bp, Homo sapiens
gtttctgcctttctg

SEQ ID NO: 484524 - DNA, 15 bp, Homo sapiens
tttctgcctttctgg

SEQ ID NO: 484525 - DNA, 15 bp, Homo sapiens
ttctgcctttctggt

SEQ ID NO: 484526 - DNA, 15 bp, Homo sapiens
tctgcctttctggtg

SEQ ID NO: 484527 - DNA, 15 bp, Homo sapiens
ctgcctttctggtgc

SEQ ID NO: 484528 - DNA, 15 bp, Homo sapiens
tgcctttctggtgcc

SEQ ID NO: 484529 - DNA, 15 bp, Homo sapiens
gcctttctggtgcct

SEQ ID NO: 484530 - DNA, 15 bp, Homo sapiens
cctttctggtgcctg

SEQ ID NO: 484531 - DNA, 15 bp, Homo sapiens
ctttctggtgcctgc

SEQ ID NO: 484532 - DNA, 15 bp, Homo sapiens
tttctggtgcctgcc

SEQ ID NO: 484533 - DNA, 15 bp, Homo sapiens
ttctggtgcctgcca

SEQ ID NO: 484534 - DNA, 15 bp, Homo sapiens
tctggtgcctgccat

SEQ ID NO: 484535 - DNA, 15 bp, Homo sapiens
ctggtgcctgccatc

SEQ ID NO: 484536 - DNA, 15 bp, Homo sapiens
tggtgcctgccatct

SEQ ID NO: 484537 - DNA, 15 bp, Homo sapiens
ggtgcctgccatctt

SEQ ID NO: 484538 - DNA, 15 bp, Homo sapiens
gtgcctgccatcttg

SEQ ID NO: 484539 - DNA, 15 bp, Homo sapiens
tgcctgccatcttgt

SEQ ID NO: 484540 - DNA, 15 bp, Homo sapiens
gcctgccatcttgtt

SEQ ID NO: 484541 - DNA, 15 bp, Homo sapiens
cctgccatcttgtta

SEQ ID NO: 484542 - DNA, 15 bp, Homo sapiens
ctgccatcttgttag

SEQ ID NO: 484543 - DNA, 15 bp, Homo sapiens
tgccatcttgttaga

SEQ ID NO: 484544 - DNA, 15 bp, Homo sapiens
gccatcttgttagag

SEQ ID NO: 484545 - DNA, 15 bp, Homo sapiens
ccatcttgttagaga

SEQ ID NO: 484546 - DNA, 15 bp, Homo sapiens
catcttgttagagat

SEQ ID NO: 484547 - DNA, 15 bp, Homo sapiens
atcttgttagagatc

SEQ ID NO: 484548 - DNA, 15 bp, Homo sapiens
tcttgttagagatca

SEQ ID NO: 484549 - DNA, 15 bp, Homo sapiens
cttgttagagatcac

SEQ ID NO: 484550 - DNA, 15 bp, Homo sapiens
ttgttagagatcaca

SEQ ID NO: 484551 - DNA, 15 bp, Homo sapiens
tgttagagatcacag

SEQ ID NO: 484552 - DNA, 15 bp, Homo sapiens
gttagagatcacagc

SEQ ID NO: 484553 - DNA, 15 bp, Homo sapiens
ttagagatcacagca

SEQ ID NO: 484554 - DNA, 15 bp, Homo sapiens
tagagatcacagcaa

SEQ ID NO: 484555 - DNA, 15 bp, Homo sapiens
agagatcacagcaag

SEQ ID NO: 484556 - DNA, 15 bp, Homo sapiens
gagatcacagcaaga

SEQ ID NO: 484557 - DNA, 15 bp, Homo sapiens
agatcacagcaagat

SEQ ID NO: 484558 - DNA, 15 bp, Homo sapiens
gatcacagcaagata

SEQ ID NO: 484559 - DNA, 15 bp, Homo sapiens
atcacagcaagatac

SEQ ID NO: 484560 - DNA, 15 bp, Homo sapiens
tcacagcaagatact

SEQ ID NO: 484561 - DNA, 15 bp, Homo sapiens
cacagcaagatactt

SEQ ID NO: 484562 - DNA, 15 bp, Homo sapiens
acagcaagatacttt

SEQ ID NO: 484563 - DNA, 15 bp, Homo sapiens
cagcaagatactttc

SEQ ID NO: 484564 - DNA, 15 bp, Homo sapiens
agcaagatactttca

SEQ ID NO: 484565 - DNA, 15 bp, Homo sapiens
gcaagatactttcat

SEQ ID NO: 484566 - DNA, 15 bp, Homo sapiens
caagatactttcata

SEQ ID NO: 484567 - DNA, 15 bp, Homo sapiens
aagatactttcatat

SEQ ID NO: 484568 - DNA, 15 bp, Homo sapiens
agatactttcatatg

SEQ ID NO: 484569 - DNA, 15 bp, Homo sapiens
gatactttcatatgt

SEQ ID NO: 484570 - DNA, 15 bp, Homo sapiens
atactttcatatgtg

SEQ ID NO: 484571 - DNA, 15 bp, Homo sapiens
tactttcatatgtga

SEQ ID NO: 484572 - DNA, 15 bp, Homo sapiens
actttcatatgtgaa

SEQ ID NO: 484573 - DNA, 15 bp, Homo sapiens
ctttcatatgtgaag

SEQ ID NO: 484574 - DNA, 15 bp, Homo sapiens
tttcatatgtgaaga

SEQ ID NO: 484575 - DNA, 15 bp, Homo sapiens
ttcatatgtgaagac

SEQ ID NO: 484576 - DNA, 15 bp, Homo sapiens
tcatatgtgaagaca

SEQ ID NO: 484577 - DNA, 15 bp, Homo sapiens
catatgtgaagacac

SEQ ID NO: 484578 - DNA, 15 bp, Homo sapiens
atatgtgaagacaca

SEQ ID NO: 484579 - DNA, 15 bp, Homo sapiens
tatgtgaagacacag

SEQ ID NO: 484580 - DNA, 15 bp, Homo sapiens
atgtgaagacacagc

SEQ ID NO: 484581 - DNA, 15 bp, Homo sapiens
tgtgaagacacagca

SEQ ID NO: 484582 - DNA, 15 bp, Homo sapiens
gtgaagacacagcac

SEQ ID NO: 484583 - DNA, 15 bp, Homo sapiens
tgaagacacagcaca

SEQ ID NO: 484584 - DNA, 15 bp, Homo sapiens
gaagacacagcacac

SEQ ID NO: 484585 - DNA, 15 bp, Homo sapiens
aagacacagcacact

SEQ ID NO: 484586 - DNA, 15 bp, Homo sapiens
agacacagcacactg

SEQ ID NO: 484587 - DNA, 15 bp, Homo sapiens
gacacagcacactgt

SEQ ID NO: 484588 - DNA, 15 bp, Homo sapiens
acacagcacactgta

SEQ ID NO: 484589 - DNA, 15 bp, Homo sapiens
cacagcacactgtag

SEQ ID NO: 484590 - DNA, 15 bp, Homo sapiens
acagcacactgtagg

SEQ ID NO: 484591 - DNA, 15 bp, Homo sapiens
cagcacactgtaggg

SEQ ID NO: 484592 - DNA, 15 bp, Homo sapiens
agcacactgtaggga

SEQ ID NO: 484593 - DNA, 15 bp, Homo sapiens
gcacactgtagggaa

SEQ ID NO: 484594 - DNA, 15 bp, Homo sapiens
cacactgtagggaat

SEQ ID NO: 484595 - DNA, 15 bp, Homo sapiens
acactgtagggaatt

SEQ ID NO: 484596 - DNA, 15 bp, Homo sapiens
cactgtagggaatta

SEQ ID NO: 484597 - DNA, 15 bp, Homo sapiens
actgtagggaattaa

SEQ ID NO: 484598 - DNA, 15 bp, Homo sapiens
ctgtagggaattaag

SEQ ID NO: 484599 - DNA, 15 bp, Homo sapiens
tgtagggaattaagt

SEQ ID NO: 484600 - DNA, 15 bp, Homo sapiens
gtagggaattaagtg

SEQ ID NO: 484601 - DNA, 15 bp, Homo sapiens
tagggaattaagtgc

SEQ ID NO: 484602 - DNA, 15 bp, Homo sapiens
agggaattaagtgct

SEQ ID NO: 484603 - DNA, 15 bp, Homo sapiens
gggaattaagtgctt

SEQ ID NO: 484604 - DNA, 15 bp, Homo sapiens
ggaattaagtgcttg

SEQ ID NO: 484605 - DNA, 15 bp, Homo sapiens
gaattaagtgcttga

SEQ ID NO: 484606 - DNA, 15 bp, Homo sapiens
aattaagtgcttgat

SEQ ID NO: 484607 - DNA, 15 bp, Homo sapiens
attaagtgcttgatg

SEQ ID NO: 484608 - DNA, 15 bp, Homo sapiens
ttaagtgcttgatgg

SEQ ID NO: 484609 - DNA, 15 bp, Homo sapiens
taagtgcttgatggc

SEQ ID NO: 484610 - DNA, 15 bp, Homo sapiens
aagtgcttgatggca

SEQ ID NO: 484611 - DNA, 15 bp, Homo sapiens
agtgcttgatggcac

SEQ ID NO: 484612 - DNA, 15 bp, Homo sapiens
gtgcttgatggcaca

SEQ ID NO: 484613 - DNA, 15 bp, Homo sapiens
tgcttgatggcacat

SEQ ID NO: 484614 - DNA, 15 bp, Homo sapiens
gcttgatggcacata

SEQ ID NO: 484615 - DNA, 15 bp, Homo sapiens
cttgatggcacatag

SEQ ID NO: 484616 - DNA, 15 bp, Homo sapiens
ttgatggcacatagt

SEQ ID NO: 484617 - DNA, 15 bp, Homo sapiens
tgatggcacatagta

SEQ ID NO: 484618 - DNA, 15 bp, Homo sapiens
gatggcacatagtag

SEQ ID NO: 484619 - DNA, 15 bp, Homo sapiens
atggcacatagtagt

SEQ ID NO: 484620 - DNA, 15 bp, Homo sapiens
tggcacatagtagtt

SEQ ID NO: 484621 - DNA, 15 bp, Homo sapiens
ggcacatagtagtta

SEQ ID NO: 484622 - DNA, 15 bp, Homo sapiens
gcacatagtagttag

SEQ ID NO: 484623 - DNA, 15 bp, Homo sapiens
cacatagtagttagg

SEQ ID NO: 484624 - DNA, 15 bp, Homo sapiens
acatagtagttagga

SEQ ID NO: 484625 - DNA, 15 bp, Homo sapiens
catagtagttaggaa

SEQ ID NO: 484626 - DNA, 15 bp, Homo sapiens
atagtagttaggaat

SEQ ID NO: 484627 - DNA, 15 bp, Homo sapiens
tagtagttaggaata

SEQ ID NO: 484628 - DNA, 15 bp, Homo sapiens
agtagttaggaatag

SEQ ID NO: 484629 - DNA, 15 bp, Homo sapiens
gtagttaggaatagg

SEQ ID NO: 484630 - DNA, 15 bp, Homo sapiens
tagttaggaatagga

SEQ ID NO: 484631 - DNA, 15 bp, Homo sapiens
agttaggaataggag

SEQ ID NO: 484632 - DNA, 15 bp, Homo sapiens
gttaggaataggagt

SEQ ID NO: 484633 - DNA, 15 bp, Homo sapiens
ttaggaataggagtg

SEQ ID NO: 484634 - DNA, 15 bp, Homo sapiens
taggaataggagtga

SEQ ID NO: 484635 - DNA, 15 bp, Homo sapiens
aggaataggagtgat

SEQ ID NO: 484636 - DNA, 15 bp, Homo sapiens
ggaataggagtgatg

SEQ ID NO: 484637 - DNA, 15 bp, Homo sapiens
gaataggagtgatgt

SEQ ID NO: 484638 - DNA, 15 bp, Homo sapiens
aataggagtgatgtc

SEQ ID NO: 484639 - DNA, 15 bp, Homo sapiens
ataggagtgatgtct

SEQ ID NO: 484640 - DNA, 15 bp, Homo sapiens
taggagtgatgtctc

SEQ ID NO: 484641 - DNA, 15 bp, Homo sapiens
aggagtgatgtctca

SEQ ID NO: 484642 - DNA, 15 bp, Homo sapiens
ggagtgatgtctcag

SEQ ID NO: 484643 - DNA, 15 bp, Homo sapiens
gagtgatgtctcaga

SEQ ID NO: 484644 - DNA, 15 bp, Homo sapiens
agtgatgtctcagaa

SEQ ID NO: 484645 - DNA, 15 bp, Homo sapiens
gtgatgtctcagaag

SEQ ID NO: 484646 - DNA, 15 bp, Homo sapiens
tgatgtctcagaagt

SEQ ID NO: 484647 - DNA, 15 bp, Homo sapiens
gatgtctcagaagta

SEQ ID NO: 484648 - DNA, 15 bp, Homo sapiens
atgtctcagaagtag

SEQ ID NO: 484649 - DNA, 15 bp, Homo sapiens
tgtctcagaagtagt

SEQ ID NO: 484650 - DNA, 15 bp, Homo sapiens
gtctcagaagtagtg

SEQ ID NO: 484651 - DNA, 15 bp, Homo sapiens
tctcagaagtagtga

SEQ ID NO: 484652 - DNA, 15 bp, Homo sapiens
ctcagaagtagtgat

SEQ ID NO: 484653 - DNA, 15 bp, Homo sapiens
tcagaagtagtgatg

SEQ ID NO: 484654 - DNA, 15 bp, Homo sapiens
cagaagtagtgatgg

SEQ ID NO: 484655 - DNA, 15 bp, Homo sapiens
agaagtagtgatgga

SEQ ID NO: 484656 - DNA, 15 bp, Homo sapiens
aagtagtgatggaga

SEQ ID NO: 484657 - DNA, 15 bp, Homo sapiens
agtagtgatggagag

SEQ ID NO: 484658 - DNA, 15 bp, Homo sapiens
gtagtgatggagaga

SEQ ID NO: 484659 - DNA, 15 bp, Homo sapiens
tagtgatggagagac

SEQ ID NO: 484660 - DNA, 15 bp, Homo sapiens
agtgatggagagacc

SEQ ID NO: 484661 - DNA, 15 bp, Homo sapiens
gtgatggagagacct

SEQ ID NO: 484662 - DNA, 15 bp, Homo sapiens
tgatggagagacctt

SEQ ID NO: 484663 - DNA, 15 bp, Homo sapiens
gatggagagaccttt

SEQ ID NO: 484664 - DNA, 15 bp, Homo sapiens
atggagagacctttg

SEQ ID NO: 484665 - DNA, 15 bp, Homo sapiens
tggagagacctttgc

SEQ ID NO: 484666 - DNA, 15 bp, Homo sapiens
ggagagacctttgca

SEQ ID NO: 484667 - DNA, 15 bp, Homo sapiens
gagagacctttgcag

SEQ ID NO: 484668 - DNA, 15 bp, Homo sapiens
agagacctttgcagc

SEQ ID NO: 484669 - DNA, 15 bp, Homo sapiens
gagacctttgcagca

SEQ ID NO: 484670 - DNA, 15 bp, Homo sapiens
agacctttgcagcag

SEQ ID NO: 484671 - DNA, 15 bp, Homo sapiens
gacctttgcagcagg

SEQ ID NO: 484672 - DNA, 15 bp, Homo sapiens
acctttgcagcaggt

SEQ ID NO: 484673 - DNA, 15 bp, Homo sapiens
cctttgcagcaggtg

SEQ ID NO: 484674 - DNA, 15 bp, Homo sapiens
ctttgcagcaggtgc

SEQ ID NO: 484675 - DNA, 15 bp, Homo sapiens
tttgcagcaggtgca

SEQ ID NO: 484676 - DNA, 15 bp, Homo sapiens
ttgcagcaggtgcag

SEQ ID NO: 484677 - DNA, 15 bp, Homo sapiens
tgcagcaggtgcaga

SEQ ID NO: 484678 - DNA, 15 bp, Homo sapiens
gcagcaggtgcagag

SEQ ID NO: 484679 - DNA, 15 bp, Homo sapiens
cagcaggtgcagaga

SEQ ID NO: 484680 - DNA, 15 bp, Homo sapiens
agcaggtgcagagag

SEQ ID NO: 484681 - DNA, 15 bp, Homo sapiens
gcaggtgcagagagc

SEQ ID NO: 484682 - DNA, 15 bp, Homo sapiens
caggtgcagagagcg

SEQ ID NO: 484683 - DNA, 15 bp, Homo sapiens
aggtgcagagagcgt

SEQ ID NO: 484684 - DNA, 15 bp, Homo sapiens
ggtgcagagagcgta

SEQ ID NO: 484685 - DNA, 15 bp, Homo sapiens
gtgcagagagcgtag

SEQ ID NO: 484686 - DNA, 15 bp, Homo sapiens
tgcagagagcgtaga

SEQ ID NO: 484687 - DNA, 15 bp, Homo sapiens
gcagagagcgtagag

SEQ ID NO: 484688 - DNA, 15 bp, Homo sapiens
cagagagcgtagagt

SEQ ID NO: 484689 - DNA, 15 bp, Homo sapiens
agagagcgtagagtc

SEQ ID NO: 484690 - DNA, 15 bp, Homo sapiens
gagagcgtagagtcc

SEQ ID NO: 484691 - DNA, 15 bp, Homo sapiens
agagcgtagagtccc

SEQ ID NO: 484692 - DNA, 15 bp, Homo sapiens
gagcgtagagtccca

SEQ ID NO: 484693 - DNA, 15 bp, Homo sapiens
agcgtagagtcccag

SEQ ID NO: 484694 - DNA, 15 bp, Homo sapiens
gcgtagagtcccagc

SEQ ID NO: 484695 - DNA, 15 bp, Homo sapiens
cgtagagtcccagca

SEQ ID NO: 484696 - DNA, 15 bp, Homo sapiens
gtagagtcccagcac

SEQ ID NO: 484697 - DNA, 15 bp, Homo sapiens
tagagtcccagcaca

SEQ ID NO: 484698 - DNA, 15 bp, Homo sapiens
agagtcccagcacag

SEQ ID NO: 484699 - DNA, 15 bp, Homo sapiens
gagtcccagcacagg

SEQ ID NO: 484700 - DNA, 15 bp, Homo sapiens
agtcccagcacaggg

SEQ ID NO: 484701 - DNA, 15 bp, Homo sapiens
gtcccagcacagggg

SEQ ID NO: 484702 - DNA, 15 bp, Homo sapiens
tcccagcacaggggc

SEQ ID NO: 484703 - DNA, 15 bp, Homo sapiens
cccagcacaggggcc

SEQ ID NO: 484704 - DNA, 15 bp, Homo sapiens
ccagcacaggggcca

SEQ ID NO: 484705 - DNA, 15 bp, Homo sapiens
cagcacaggggccaa

SEQ ID NO: 484706 - DNA, 15 bp, Homo sapiens
agcacaggggccaag

SEQ ID NO: 484707 - DNA, 15 bp, Homo sapiens
gcacaggggccaaga

SEQ ID NO: 484708 - DNA, 15 bp, Homo sapiens
cacaggggccaagag

SEQ ID NO: 484709 - DNA, 15 bp, Homo sapiens
acaggggccaagagc

SEQ ID NO: 484710 - DNA, 15 bp, Homo sapiens
caggggccaagagct

SEQ ID NO: 484711 - DNA, 15 bp, Homo sapiens
aggggccaagagctc

SEQ ID NO: 484712 - DNA, 15 bp, Homo sapiens
ggggccaagagctcc

SEQ ID NO: 484713 - DNA, 15 bp, Homo sapiens
gggccaagagctcct

SEQ ID NO: 484714 - DNA, 15 bp, Homo sapiens
ggccaagagctcctc

SEQ ID NO: 484715 - DNA, 15 bp, Homo sapiens
gccaagagctcctct

SEQ ID NO: 484716 - DNA, 15 bp, Homo sapiens
ccaagagctcctctc

SEQ ID NO: 484717 - DNA, 15 bp, Homo sapiens
caagagctcctctct

SEQ ID NO: 484718 - DNA, 15 bp, Homo sapiens
aagagctcctctctc

SEQ ID NO: 484719 - DNA, 15 bp, Homo sapiens
agagctcctctctct

SEQ ID NO: 484720 - DNA, 15 bp, Homo sapiens
gagctcctctctctt

SEQ ID NO: 484721 - DNA, 15 bp, Homo sapiens
agctcctctctcttg

SEQ ID NO: 484722 - DNA, 15 bp, Homo sapiens
gctcctctctcttga

SEQ ID NO: 484723 - DNA, 15 bp, Homo sapiens
ctcctctctcttgaa

SEQ ID NO: 484724 - DNA, 15 bp, Homo sapiens
tcctctctcttgaag

SEQ ID NO: 484725 - DNA, 15 bp, Homo sapiens
cctctctcttgaaga

SEQ ID NO: 484726 - DNA, 15 bp, Homo sapiens
ctctctcttgaagaa

SEQ ID NO: 484727 - DNA, 15 bp, Homo sapiens
tctctcttgaagaat

SEQ ID NO: 484728 - DNA, 15 bp, Homo sapiens
ctctcttgaagaatc

SEQ ID NO: 484729 - DNA, 15 bp, Homo sapiens
tctcttgaagaatcc

SEQ ID NO: 484730 - DNA, 15 bp, Homo sapiens
ctcttgaagaatccc

SEQ ID NO: 484731 - DNA, 15 bp, Homo sapiens
tcttgaagaatccct

SEQ ID NO: 484732 - DNA, 15 bp, Homo sapiens
cttgaagaatccctg

SEQ ID NO: 484733 - DNA, 15 bp, Homo sapiens
ttgaagaatccctga

SEQ ID NO: 484734 - DNA, 15 bp, Homo sapiens
tgaagaatccctgac

SEQ ID NO: 484735 - DNA, 15 bp, Homo sapiens
gaagaatccctgaca

SEQ ID NO: 484736 - DNA, 15 bp, Homo sapiens
aagaatccctgacat

SEQ ID NO: 484737 - DNA, 15 bp, Homo sapiens
agaatccctgacatc

SEQ ID NO: 484738 - DNA, 15 bp, Homo sapiens
gaatccctgacatca

SEQ ID NO: 484739 - DNA, 15 bp, Homo sapiens
aatccctgacatcaa

SEQ ID NO: 484740 - DNA, 15 bp, Homo sapiens
atccctgacatcaac

SEQ ID NO: 484741 - DNA, 15 bp, Homo sapiens
tccctgacatcaaca

SEQ ID NO: 484742 - DNA, 15 bp, Homo sapiens
ccctgacatcaacat

SEQ ID NO: 484743 - DNA, 15 bp, Homo sapiens
cctgacatcaacatg

SEQ ID NO: 484744 - DNA, 15 bp, Homo sapiens
ctgacatcaacatgc

SEQ ID NO: 484745 - DNA, 15 bp, Homo sapiens
tgacatcaacatgca

SEQ ID NO: 484746 - DNA, 15 bp, Homo sapiens
gacatcaacatgcat

SEQ ID NO: 484747 - DNA, 15 bp, Homo sapiens
acatcaacatgcatg

SEQ ID NO: 484748 - DNA, 15 bp, Homo sapiens
catcaacatgcatgt

SEQ ID NO: 484749 - DNA, 15 bp, Homo sapiens
atcaacatgcatgtc

SEQ ID NO: 484750 - DNA, 15 bp, Homo sapiens
tcaacatgcatgtca

SEQ ID NO: 484751 - DNA, 15 bp, Homo sapiens
caacatgcatgtcat

SEQ ID NO: 484752 - DNA, 15 bp, Homo sapiens
aacatgcatgtcatc

SEQ ID NO: 484753 - DNA, 15 bp, Homo sapiens
acatgcatgtcatct

SEQ ID NO: 484754 - DNA, 15 bp, Homo sapiens
catgcatgtcatctt

SEQ ID NO: 484755 - DNA, 15 bp, Homo sapiens
atgcatgtcatcttt

SEQ ID NO: 484756 - DNA, 15 bp, Homo sapiens
tgcatgtcatcttta

SEQ ID NO: 484757 - DNA, 15 bp, Homo sapiens
gcatgtcatctttag

SEQ ID NO: 484758 - DNA, 15 bp, Homo sapiens
catgtcatctttagt

SEQ ID NO: 484759 - DNA, 15 bp, Homo sapiens
atgtcatctttagtc

SEQ ID NO: 484760 - DNA, 15 bp, Homo sapiens
tgtcatctttagtct

SEQ ID NO: 484761 - DNA, 15 bp, Homo sapiens
gtcatctttagtctt

SEQ ID NO: 484762 - DNA, 15 bp, Homo sapiens
tcatctttagtcttt

SEQ ID NO: 484763 - DNA, 15 bp, Homo sapiens
catctttagtctttt

SEQ ID NO: 484764 - DNA, 15 bp, Homo sapiens
atctttagtcttttt

SEQ ID NO: 484765 - DNA, 15 bp, Homo sapiens
tctttagtctttttc

SEQ ID NO: 484766 - DNA, 15 bp, Homo sapiens
ctttagtctttttct

SEQ ID NO: 484767 - DNA, 15 bp, Homo sapiens
tttagtctttttctc

SEQ ID NO: 484768 - DNA, 15 bp, Homo sapiens
ttagtctttttctct

SEQ ID NO: 484769 - DNA, 15 bp, Homo sapiens
tagtctttttctcta

SEQ ID NO: 484770 - DNA, 15 bp, Homo sapiens
agtctttttctctag

SEQ ID NO: 484771 - DNA, 15 bp, Homo sapiens
gtctttttctctagc

SEQ ID NO: 484772 - DNA, 15 bp, Homo sapiens
tctttttctctagcc

SEQ ID NO: 484773 - DNA, 15 bp, Homo sapiens
ctttttctctagcct

SEQ ID NO: 484774 - DNA, 15 bp, Homo sapiens
tttttctctagcctg

SEQ ID NO: 484775 - DNA, 15 bp, Homo sapiens
ttttctctagcctgt

SEQ ID NO: 484776 - DNA, 15 bp, Homo sapiens
tttctctagcctgtg

SEQ ID NO: 484777 - DNA, 15 bp, Homo sapiens
ttctctagcctgtgc

SEQ ID NO: 484778 - DNA, 15 bp, Homo sapiens
tctctagcctgtgct

SEQ ID NO: 484779 - DNA, 15 bp, Homo sapiens
ctctagcctgtgctg

SEQ ID NO: 484780 - DNA, 15 bp, Homo sapiens
tctagcctgtgctgt

SEQ ID NO: 484781 - DNA, 15 bp, Homo sapiens
ctagcctgtgctgtg

SEQ ID NO: 484782 - DNA, 15 bp, Homo sapiens
tagcctgtgctgtgt

SEQ ID NO: 484783 - DNA, 15 bp, Homo sapiens
agcctgtgctgtgtg

SEQ ID NO: 484784 - DNA, 15 bp, Homo sapiens
gcctgtgctgtgtgg

SEQ ID NO: 484785 - DNA, 15 bp, Homo sapiens
cctgtgctgtgtgga

SEQ ID NO: 484786 - DNA, 15 bp, Homo sapiens
ctgtgctgtgtggag

SEQ ID NO: 484787 - DNA, 15 bp, Homo sapiens
tgtgctgtgtggagc

SEQ ID NO: 484788 - DNA, 15 bp, Homo sapiens
gtgctgtgtggagct

SEQ ID NO: 484789 - DNA, 15 bp, Homo sapiens
tgctgtgtggagctc

SEQ ID NO: 484790 - DNA, 15 bp, Homo sapiens
gctgtgtggagctcc

SEQ ID NO: 484791 - DNA, 15 bp, Homo sapiens
ctgtgtggagctcct

SEQ ID NO: 484792 - DNA, 15 bp, Homo sapiens
tgtgtggagctccta

SEQ ID NO: 484793 - DNA, 15 bp, Homo sapiens
gtgtggagctcctat

SEQ ID NO: 484794 - DNA, 15 bp, Homo sapiens
tgtggagctcctatg

SEQ ID NO: 484795 - DNA, 15 bp, Homo sapiens
gtggagctcctatgt

SEQ ID NO: 484796 - DNA, 15 bp, Homo sapiens
tggagctcctatgtg

SEQ ID NO: 484797 - DNA, 15 bp, Homo sapiens
ggagctcctatgtga

SEQ ID NO: 484798 - DNA, 15 bp, Homo sapiens
gagctcctatgtgat

SEQ ID NO: 484799 - DNA, 15 bp, Homo sapiens
agctcctatgtgata

SEQ ID NO: 484800 - DNA, 15 bp, Homo sapiens
gctcctatgtgatat

SEQ ID NO: 484801 - DNA, 15 bp, Homo sapiens
ctcctatgtgatata

SEQ ID NO: 484802 - DNA, 15 bp, Homo sapiens
tcctatgtgatataa

SEQ ID NO: 484803 - DNA, 15 bp, Homo sapiens
cctatgtgatataat

SEQ ID NO: 484804 - DNA, 15 bp, Homo sapiens
ctatgtgatataata

SEQ ID NO: 484805 - DNA, 15 bp, Homo sapiens
tatgtgatataatag

SEQ ID NO: 484806 - DNA, 15 bp, Homo sapiens
atgtgatataatagg

SEQ ID NO: 484807 - DNA, 15 bp, Homo sapiens
tgtgatataatagga

SEQ ID NO: 484808 - DNA, 15 bp, Homo sapiens
gtgatataataggag

SEQ ID NO: 484809 - DNA, 15 bp, Homo sapiens
tgatataataggagt

SEQ ID NO: 484810 - DNA, 15 bp, Homo sapiens
gatataataggagtg

SEQ ID NO: 484811 - DNA, 15 bp, Homo sapiens
atataataggagtgc

SEQ ID NO: 484812 - DNA, 15 bp, Homo sapiens
tataataggagtgcc

SEQ ID NO: 484813 - DNA, 15 bp, Homo sapiens
ataataggagtgcct

SEQ ID NO: 484814 - DNA, 15 bp, Homo sapiens
taataggagtgcctt

SEQ ID NO: 484815 - DNA, 15 bp, Homo sapiens
aataggagtgccttt

SEQ ID NO: 484816 - DNA, 15 bp, Homo sapiens
ataggagtgcctttc

SEQ ID NO: 484817 - DNA, 15 bp, Homo sapiens
taggagtgcctttct

SEQ ID NO: 484818 - DNA, 15 bp, Homo sapiens
aggagtgcctttctc

SEQ ID NO: 484819 - DNA, 15 bp, Homo sapiens
ggagtgcctttctcc

SEQ ID NO: 484820 - DNA, 15 bp, Homo sapiens
gagtgcctttctcca

SEQ ID NO: 484821 - DNA, 15 bp, Homo sapiens
agtgcctttctccag

SEQ ID NO: 484822 - DNA, 15 bp, Homo sapiens
gtgcctttctccaga

SEQ ID NO: 484823 - DNA, 15 bp, Homo sapiens
tgcctttctccagaa

SEQ ID NO: 484824 - DNA, 15 bp, Homo sapiens
gcctttctccagaaa

SEQ ID NO: 484825 - DNA, 15 bp, Homo sapiens
cctttctccagaaat

SEQ ID NO: 484826 - DNA, 15 bp, Homo sapiens
ctttctccagaaatg

SEQ ID NO: 484827 - DNA, 15 bp, Homo sapiens
tttctccagaaatga

SEQ ID NO: 484828 - DNA, 15 bp, Homo sapiens
ttctccagaaatgat

SEQ ID NO: 484829 - DNA, 15 bp, Homo sapiens
tctccagaaatgatt

SEQ ID NO: 484830 - DNA, 15 bp, Homo sapiens
ctccagaaatgattt

SEQ ID NO: 484831 - DNA, 15 bp, Homo sapiens
tccagaaatgattta

SEQ ID NO: 484832 - DNA, 15 bp, Homo sapiens
ccagaaatgatttat

SEQ ID NO: 484833 - DNA, 15 bp, Homo sapiens
cagaaatgatttatt

SEQ ID NO: 484834 - DNA, 15 bp, Homo sapiens
agaaatgatttattg

SEQ ID NO: 484835 - DNA, 15 bp, Homo sapiens
gaaatgatttattga

SEQ ID NO: 484836 - DNA, 15 bp, Homo sapiens
aaatgatttattgac

SEQ ID NO: 484837 - DNA, 15 bp, Homo sapiens
aatgatttattgact

SEQ ID NO: 484838 - DNA, 15 bp, Homo sapiens
atgatttattgactc

SEQ ID NO: 484839 - DNA, 15 bp, Homo sapiens
tgatttattgactca

SEQ ID NO: 484840 - DNA, 15 bp, Homo sapiens
gatttattgactcaa

SEQ ID NO: 484841 - DNA, 15 bp, Homo sapiens
atttattgactcaaa

SEQ ID NO: 484842 - DNA, 15 bp, Homo sapiens
tttattgactcaaag

SEQ ID NO: 484843 - DNA, 15 bp, Homo sapiens
ttattgactcaaagc

SEQ ID NO: 484844 - DNA, 15 bp, Homo sapiens
tattgactcaaagca

SEQ ID NO: 484845 - DNA, 15 bp, Homo sapiens
attgactcaaagcag

SEQ ID NO: 484846 - DNA, 15 bp, Homo sapiens
ttgactcaaagcagg

SEQ ID NO: 484847 - DNA, 15 bp, Homo sapiens
tgactcaaagcagga

SEQ ID NO: 484848 - DNA, 15 bp, Homo sapiens
gactcaaagcaggaa

SEQ ID NO: 484849 - DNA, 15 bp, Homo sapiens
actcaaagcaggaac

SEQ ID NO: 484850 - DNA, 15 bp, Homo sapiens
ctcaaagcaggaaca

SEQ ID NO: 484851 - DNA, 15 bp, Homo sapiens
tcaaagcaggaacaa

SEQ ID NO: 484852 - DNA, 15 bp, Homo sapiens
caaagcaggaacaac

SEQ ID NO: 484853 - DNA, 15 bp, Homo sapiens
aaagcaggaacaact

SEQ ID NO: 484854 - DNA, 15 bp, Homo sapiens
aagcaggaacaactt

SEQ ID NO: 484855 - DNA, 15 bp, Homo sapiens
agcaggaacaacttt

SEQ ID NO: 484856 - DNA, 15 bp, Homo sapiens
gcaggaacaactttc

SEQ ID NO: 484857 - DNA, 15 bp, Homo sapiens
caggaacaactttct

SEQ ID NO: 484858 - DNA, 15 bp, Homo sapiens
aggaacaactttctc

SEQ ID NO: 484859 - DNA, 15 bp, Homo sapiens
ggaacaactttctct

SEQ ID NO: 484860 - DNA, 15 bp, Homo sapiens
gaacaactttctctc

SEQ ID NO: 484861 - DNA, 15 bp, Homo sapiens
aacaactttctctcc

SEQ ID NO: 484862 - DNA, 15 bp, Homo sapiens
acaactttctctcca

SEQ ID NO: 484863 - DNA, 15 bp, Homo sapiens
caactttctctccag

SEQ ID NO: 484864 - DNA, 15 bp, Homo sapiens
aactttctctccagt

SEQ ID NO: 484865 - DNA, 15 bp, Homo sapiens
actttctctccagtg

SEQ ID NO: 484866 - DNA, 15 bp, Homo sapiens
ctttctctccagtga

SEQ ID NO: 484867 - DNA, 15 bp, Homo sapiens
tttctctccagtgat

SEQ ID NO: 484868 - DNA, 15 bp, Homo sapiens
ttctctccagtgatt

SEQ ID NO: 484869 - DNA, 15 bp, Homo sapiens
tctctccagtgattc

SEQ ID NO: 484870 - DNA, 15 bp, Homo sapiens
ctctccagtgattct

SEQ ID NO: 484871 - DNA, 15 bp, Homo sapiens
tctccagtgattctc

SEQ ID NO: 484872 - DNA, 15 bp, Homo sapiens
ctccagtgattctct

SEQ ID NO: 484873 - DNA, 15 bp, Homo sapiens
tccagtgattctctc

SEQ ID NO: 484874 - DNA, 15 bp, Homo sapiens
ccagtgattctctca

SEQ ID NO: 484875 - DNA, 15 bp, Homo sapiens
cagtgattctctcaa

SEQ ID NO: 484876 - DNA, 15 bp, Homo sapiens
agtgattctctcaaa

SEQ ID NO: 484877 - DNA, 15 bp, Homo sapiens
gtgattctctcaaat

SEQ ID NO: 484878 - DNA, 15 bp, Homo sapiens
tgattctctcaaatt

SEQ ID NO: 484879 - DNA, 15 bp, Homo sapiens
gattctctcaaattt

SEQ ID NO: 484880 - DNA, 15 bp, Homo sapiens
attctctcaaatttt

SEQ ID NO: 484881 - DNA, 15 bp, Homo sapiens
ttctctcaaatttta

SEQ ID NO: 484882 - DNA, 15 bp, Homo sapiens
tctctcaaattttag

SEQ ID NO: 484883 - DNA, 15 bp, Homo sapiens
ctctcaaattttaga

SEQ ID NO: 484884 - DNA, 15 bp, Homo sapiens
tctcaaattttagaa

SEQ ID NO: 484885 - DNA, 15 bp, Homo sapiens
ctcaaattttagaaa

SEQ ID NO: 484886 - DNA, 15 bp, Homo sapiens
tcaaattttagaaaa

SEQ ID NO: 484887 - DNA, 15 bp, Homo sapiens
caaattttagaaaac

SEQ ID NO: 484888 - DNA, 15 bp, Homo sapiens
aaattttagaaaact

SEQ ID NO: 484889 - DNA, 15 bp, Homo sapiens
aattttagaaaactg

SEQ ID NO: 484890 - DNA, 15 bp, Homo sapiens
attttagaaaactgc

SEQ ID NO: 484891 - DNA, 15 bp, Homo sapiens
ttttagaaaactgcc

SEQ ID NO: 484892 - DNA, 15 bp, Homo sapiens
tttagaaaactgcct

SEQ ID NO: 484893 - DNA, 15 bp, Homo sapiens
ttagaaaactgcctt

SEQ ID NO: 484894 - DNA, 15 bp, Homo sapiens
tagaaaactgccttt

SEQ ID NO: 484895 - DNA, 15 bp, Homo sapiens
agaaaactgcctttt

SEQ ID NO: 484896 - DNA, 15 bp, Homo sapiens
gaaaactgccttttc

SEQ ID NO: 484897 - DNA, 15 bp, Homo sapiens
aaaactgccttttca

SEQ ID NO: 484898 - DNA, 15 bp, Homo sapiens
aaactgccttttcac

SEQ ID NO: 484899 - DNA, 15 bp, Homo sapiens
aactgccttttcaca

SEQ ID NO: 484900 - DNA, 15 bp, Homo sapiens
actgccttttcacag

SEQ ID NO: 484901 - DNA, 15 bp, Homo sapiens
ctgccttttcacagt

SEQ ID NO: 484902 - DNA, 15 bp, Homo sapiens
tgccttttcacagtt

SEQ ID NO: 484903 - DNA, 15 bp, Homo sapiens
gccttttcacagttg

SEQ ID NO: 484904 - DNA, 15 bp, Homo sapiens
ccttttcacagttgc

SEQ ID NO: 484905 - DNA, 15 bp, Homo sapiens
cttttcacagttgct

SEQ ID NO: 484906 - DNA, 15 bp, Homo sapiens
ttttcacagttgctc

SEQ ID NO: 484907 - DNA, 15 bp, Homo sapiens
tttcacagttgctct

SEQ ID NO: 484908 - DNA, 15 bp, Homo sapiens
ttcacagttgctctc

SEQ ID NO: 484909 - DNA, 15 bp, Homo sapiens
tcacagttgctctca

SEQ ID NO: 484910 - DNA, 15 bp, Homo sapiens
cacagttgctctcag

SEQ ID NO: 484911 - DNA, 15 bp, Homo sapiens
acagttgctctcagt

SEQ ID NO: 484912 - DNA, 15 bp, Homo sapiens
cagttgctctcagtc

SEQ ID NO: 484913 - DNA, 15 bp, Homo sapiens
agttgctctcagtct

SEQ ID NO: 484914 - DNA, 15 bp, Homo sapiens
gttgctctcagtctt

SEQ ID NO: 484915 - DNA, 15 bp, Homo sapiens
ttgctctcagtcttt

SEQ ID NO: 484916 - DNA, 15 bp, Homo sapiens
tgctctcagtctttt

SEQ ID NO: 484917 - DNA, 15 bp, Homo sapiens
gctctcagtcttttt

SEQ ID NO: 484918 - DNA, 15 bp, Homo sapiens
ctctcagtcttttta

SEQ ID NO: 484919 - DNA, 15 bp, Homo sapiens
tctcagtctttttaa

SEQ ID NO: 484920 - DNA, 15 bp, Homo sapiens
ctcagtctttttaac

SEQ ID NO: 484921 - DNA, 15 bp, Homo sapiens
tcagtctttttaact

SEQ ID NO: 484922 - DNA, 15 bp, Homo sapiens
cagtctttttaactt

SEQ ID NO: 484923 - DNA, 15 bp, Homo sapiens
agtctttttaactta

SEQ ID NO: 484924 - DNA, 15 bp, Homo sapiens
gtctttttaacttac

SEQ ID NO: 484925 - DNA, 15 bp, Homo sapiens
tctttttaacttacc

SEQ ID NO: 484926 - DNA, 15 bp, Homo sapiens
ctttttaacttacca

SEQ ID NO: 484927 - DNA, 15 bp, Homo sapiens
tttttaacttaccag

SEQ ID NO: 484928 - DNA, 15 bp, Homo sapiens
ttttaacttaccaga

SEQ ID NO: 484929 - DNA, 15 bp, Homo sapiens
tttaacttaccagaa

SEQ ID NO: 484930 - DNA, 15 bp, Homo sapiens
ttaacttaccagaat

SEQ ID NO: 484931 - DNA, 15 bp, Homo sapiens
taacttaccagaata

SEQ ID NO: 484932 - DNA, 15 bp, Homo sapiens
aacttaccagaataa

SEQ ID NO: 484933 - DNA, 15 bp, Homo sapiens
acttaccagaataat

SEQ ID NO: 484934 - DNA, 15 bp, Homo sapiens
cttaccagaataatt

SEQ ID NO: 484935 - DNA, 15 bp, Homo sapiens
ttaccagaataattc

SEQ ID NO: 484936 - DNA, 15 bp, Homo sapiens
taccagaataattca

SEQ ID NO: 484937 - DNA, 15 bp, Homo sapiens
accagaataattcaa

SEQ ID NO: 484938 - DNA, 15 bp, Homo sapiens
ccagaataattcaaa

SEQ ID NO: 484939 - DNA, 15 bp, Homo sapiens
cagaataattcaaaa

SEQ ID NO: 484940 - DNA, 15 bp, Homo sapiens
agaataattcaaaac

SEQ ID NO: 484941 - DNA, 15 bp, Homo sapiens
gaataattcaaaaca

SEQ ID NO: 484942 - DNA, 15 bp, Homo sapiens
aataattcaaaacag

SEQ ID NO: 484943 - DNA, 15 bp, Homo sapiens
ataattcaaaacagt

SEQ ID NO: 484944 - DNA, 15 bp, Homo sapiens
taattcaaaacagtg

SEQ ID NO: 484945 - DNA, 15 bp, Homo sapiens
aattcaaaacagtgt

SEQ ID NO: 484946 - DNA, 15 bp, Homo sapiens
attcaaaacagtgtc

SEQ ID NO: 484947 - DNA, 15 bp, Homo sapiens
ttcaaaacagtgtca

SEQ ID NO: 484948 - DNA, 15 bp, Homo sapiens
tcaaaacagtgtcat

SEQ ID NO: 484949 - DNA, 15 bp, Homo sapiens
caaaacagtgtcatt

SEQ ID NO: 484950 - DNA, 15 bp, Homo sapiens
aaaacagtgtcattt

SEQ ID NO: 484951 - DNA, 15 bp, Homo sapiens
aaacagtgtcatttc

SEQ ID NO: 484952 - DNA, 15 bp, Homo sapiens
aacagtgtcatttct

SEQ ID NO: 484953 - DNA, 15 bp, Homo sapiens
acagtgtcatttctg

SEQ ID NO: 484954 - DNA, 15 bp, Homo sapiens
cagtgtcatttctgc

SEQ ID NO: 484955 - DNA, 15 bp, Homo sapiens
agtgtcatttctgcc

SEQ ID NO: 484956 - DNA, 15 bp, Homo sapiens
gtgtcatttctgcct

SEQ ID NO: 484957 - DNA, 15 bp, Homo sapiens
tgtcatttctgcctt

SEQ ID NO: 484958 - DNA, 15 bp, Homo sapiens
gtcatttctgcctta

SEQ ID NO: 484959 - DNA, 15 bp, Homo sapiens
tcatttctgccttac

SEQ ID NO: 484960 - DNA, 15 bp, Homo sapiens
catttctgccttacc

SEQ ID NO: 484961 - DNA, 15 bp, Homo sapiens
atttctgccttacct

SEQ ID NO: 484962 - DNA, 15 bp, Homo sapiens
tttctgccttaccta

SEQ ID NO: 484963 - DNA, 15 bp, Homo sapiens
ttctgccttacctac

SEQ ID NO: 484964 - DNA, 15 bp, Homo sapiens
tctgccttacctaca

SEQ ID NO: 484965 - DNA, 15 bp, Homo sapiens
ctgccttacctacac

SEQ ID NO: 484966 - DNA, 15 bp, Homo sapiens
tgccttacctacaca

SEQ ID NO: 484967 - DNA, 15 bp, Homo sapiens
gccttacctacacag

SEQ ID NO: 484968 - DNA, 15 bp, Homo sapiens
ccttacctacacaga

SEQ ID NO: 484969 - DNA, 15 bp, Homo sapiens
cttacctacacagaa

SEQ ID NO: 484970 - DNA, 15 bp, Homo sapiens
ttacctacacagaaa

SEQ ID NO: 484971 - DNA, 15 bp, Homo sapiens
tacctacacagaaat

SEQ ID NO: 484972 - DNA, 15 bp, Homo sapiens
acctacacagaaatt

SEQ ID NO: 484973 - DNA, 15 bp, Homo sapiens
cctacacagaaattt

SEQ ID NO: 484974 - DNA, 15 bp, Homo sapiens
ctacacagaaatttg

SEQ ID NO: 484975 - DNA, 15 bp, Homo sapiens
tacacagaaatttgt

SEQ ID NO: 484976 - DNA, 15 bp, Homo sapiens
acacagaaatttgtg

SEQ ID NO: 484977 - DNA, 15 bp, Homo sapiens
cacagaaatttgtgt

SEQ ID NO: 484978 - DNA, 15 bp, Homo sapiens
acagaaatttgtgta

SEQ ID NO: 484979 - DNA, 15 bp, Homo sapiens
cagaaatttgtgtag

SEQ ID NO: 484980 - DNA, 15 bp, Homo sapiens
agaaatttgtgtagg

SEQ ID NO: 484981 - DNA, 15 bp, Homo sapiens
gaaatttgtgtaggc

SEQ ID NO: 484982 - DNA, 15 bp, Homo sapiens
aaatttgtgtaggca

SEQ ID NO: 484983 - DNA, 15 bp, Homo sapiens
aatttgtgtaggcaa

SEQ ID NO: 484984 - DNA, 15 bp, Homo sapiens
atttgtgtaggcaat

SEQ ID NO: 484985 - DNA, 15 bp, Homo sapiens
tttgtgtaggcaatt

SEQ ID NO: 484986 - DNA, 15 bp, Homo sapiens
ttgtgtaggcaattc

SEQ ID NO: 484987 - DNA, 15 bp, Homo sapiens
tgtgtaggcaattca

SEQ ID NO: 484988 - DNA, 15 bp, Homo sapiens
gtgtaggcaattcat

SEQ ID NO: 484989 - DNA, 15 bp, Homo sapiens
tgtaggcaattcata

SEQ ID NO: 484990 - DNA, 15 bp, Homo sapiens
gtaggcaattcataa

SEQ ID NO: 484991 - DNA, 15 bp, Homo sapiens
taggcaattcataat

SEQ ID NO: 484992 - DNA, 15 bp, Homo sapiens
aggcaattcataatt

SEQ ID NO: 484993 - DNA, 15 bp, Homo sapiens
ggcaattcataattt

SEQ ID NO: 484994 - DNA, 15 bp, Homo sapiens
gcaattcataatttg

SEQ ID NO: 484995 - DNA, 15 bp, Homo sapiens
caattcataatttga

SEQ ID NO: 484996 - DNA, 15 bp, Homo sapiens
aattcataatttgac

SEQ ID NO: 484997 - DNA, 15 bp, Homo sapiens
attcataatttgacc

SEQ ID NO: 484998 - DNA, 15 bp, Homo sapiens
ttcataatttgacca

SEQ ID NO: 484999 - DNA, 15 bp, Homo sapiens
tcataatttgaccat

SEQ ID NO: 485000 - DNA, 15 bp, Homo sapiens
cataatttgaccata

SEQ ID NO: 485001 - DNA, 15 bp, Homo sapiens
ataatttgaccatac

SEQ ID NO: 485002 - DNA, 15 bp, Homo sapiens
taatttgaccataca

SEQ ID NO: 485003 - DNA, 15 bp, Homo sapiens
aatttgaccatacac

SEQ ID NO: 485004 - DNA, 15 bp, Homo sapiens
atttgaccatacact

SEQ ID NO: 485005 - DNA, 15 bp, Homo sapiens
tttgaccatacactt

SEQ ID NO: 485006 - DNA, 15 bp, Homo sapiens
ttgaccatacacttt

SEQ ID NO: 485007 - DNA, 15 bp, Homo sapiens
tgaccatacactttt

SEQ ID NO: 485008 - DNA, 15 bp, Homo sapiens
gaccatacacttttc

SEQ ID NO: 485009 - DNA, 15 bp, Homo sapiens
accatacacttttct

SEQ ID NO: 485010 - DNA, 15 bp, Homo sapiens
ccatacacttttctc

SEQ ID NO: 485011 - DNA, 15 bp, Homo sapiens
catacacttttctct

SEQ ID NO: 485012 - DNA, 15 bp, Homo sapiens
atacacttttctcta

SEQ ID NO: 485013 - DNA, 15 bp, Homo sapiens
tacacttttctctat

SEQ ID NO: 485014 - DNA, 15 bp, Homo sapiens
acacttttctctatg

SEQ ID NO: 485015 - DNA, 15 bp, Homo sapiens
cacttttctctatgt

SEQ ID NO: 485016 - DNA, 15 bp, Homo sapiens
acttttctctatgtc

SEQ ID NO: 485017 - DNA, 15 bp, Homo sapiens
cttttctctatgtct

SEQ ID NO: 485018 - DNA, 15 bp, Homo sapiens
ttttctctatgtctc

SEQ ID NO: 485019 - DNA, 15 bp, Homo sapiens
tttctctatgtctct

SEQ ID NO: 485020 - DNA, 15 bp, Homo sapiens
ttctctatgtctctc

SEQ ID NO: 485021 - DNA, 15 bp, Homo sapiens
tctctatgtctctca

SEQ ID NO: 485022 - DNA, 15 bp, Homo sapiens
ctctatgtctctcag

SEQ ID NO: 485023 - DNA, 15 bp, Homo sapiens
tctatgtctctcagt

SEQ ID NO: 485024 - DNA, 15 bp, Homo sapiens
ctatgtctctcagtg

SEQ ID NO: 485025 - DNA, 15 bp, Homo sapiens
tatgtctctcagtgt

SEQ ID NO: 485026 - DNA, 15 bp, Homo sapiens
atgtctctcagtgtt

SEQ ID NO: 485027 - DNA, 15 bp, Homo sapiens
tgtctctcagtgttt

SEQ ID NO: 485028 - DNA, 15 bp, Homo sapiens
gtctctcagtgtttc

SEQ ID NO: 485029 - DNA, 15 bp, Homo sapiens
tctctcagtgtttca

SEQ ID NO: 485030 - DNA, 15 bp, Homo sapiens
ctctcagtgtttcag

SEQ ID NO: 485031 - DNA, 15 bp, Homo sapiens
tctcagtgtttcaga

SEQ ID NO: 485032 - DNA, 15 bp, Homo sapiens
ctcagtgtttcagaa

SEQ ID NO: 485033 - DNA, 15 bp, Homo sapiens
tcagtgtttcagaat

SEQ ID NO: 485034 - DNA, 15 bp, Homo sapiens
cagtgtttcagaatt

SEQ ID NO: 485035 - DNA, 15 bp, Homo sapiens
agtgtttcagaattt

SEQ ID NO: 485036 - DNA, 15 bp, Homo sapiens
gtgtttcagaatttg

SEQ ID NO: 485037 - DNA, 15 bp, Homo sapiens
tgtttcagaatttgg

SEQ ID NO: 485038 - DNA, 15 bp, Homo sapiens
gtttcagaatttggg

SEQ ID NO: 485039 - DNA, 15 bp, Homo sapiens
tttcagaatttgggt

SEQ ID NO: 485040 - DNA, 15 bp, Homo sapiens
ttcagaatttgggtg

SEQ ID NO: 485041 - DNA, 15 bp, Homo sapiens
tcagaatttgggtga

SEQ ID NO: 485042 - DNA, 15 bp, Homo sapiens
cagaatttgggtgag

SEQ ID NO: 485043 - DNA, 15 bp, Homo sapiens
agaatttgggtgagg

SEQ ID NO: 485044 - DNA, 15 bp, Homo sapiens
gaatttgggtgaggc

SEQ ID NO: 485045 - DNA, 15 bp, Homo sapiens
aatttgggtgaggct

SEQ ID NO: 485046 - DNA, 15 bp, Homo sapiens
atttgggtgaggctg

SEQ ID NO: 485047 - DNA, 15 bp, Homo sapiens
tttgggtgaggctgt

SEQ ID NO: 485048 - DNA, 15 bp, Homo sapiens
ttgggtgaggctgtt

SEQ ID NO: 485049 - DNA, 15 bp, Homo sapiens
tgggtgaggctgttc

SEQ ID NO: 485050 - DNA, 15 bp, Homo sapiens
gggtgaggctgttca

SEQ ID NO: 485051 - DNA, 15 bp, Homo sapiens
ggtgaggctgttcaa

SEQ ID NO: 485052 - DNA, 15 bp, Homo sapiens
gtgaggctgttcaat

SEQ ID NO: 485053 - DNA, 15 bp, Homo sapiens
tgaggctgttcaatg

SEQ ID NO: 485054 - DNA, 15 bp, Homo sapiens
gaggctgttcaatgg

SEQ ID NO: 485055 - DNA, 15 bp, Homo sapiens
aggctgttcaatgga

SEQ ID NO: 485056 - DNA, 15 bp, Homo sapiens
ggctgttcaatggaa

SEQ ID NO: 485057 - DNA, 15 bp, Homo sapiens
gctgttcaatggaag

SEQ ID NO: 485058 - DNA, 15 bp, Homo sapiens
ctgttcaatggaagg

SEQ ID NO: 485059 - DNA, 15 bp, Homo sapiens
tgttcaatggaaggc

SEQ ID NO: 485060 - DNA, 15 bp, Homo sapiens
gttcaatggaaggct

SEQ ID NO: 485061 - DNA, 15 bp, Homo sapiens
ttcaatggaaggctt

SEQ ID NO: 485062 - DNA, 15 bp, Homo sapiens
tcaatggaaggctta

SEQ ID NO: 485063 - DNA, 15 bp, Homo sapiens
caatggaaggcttac

SEQ ID NO: 485064 - DNA, 15 bp, Homo sapiens
aatggaaggcttact

SEQ ID NO: 485065 - DNA, 15 bp, Homo sapiens
atggaaggcttactt

SEQ ID NO: 485066 - DNA, 15 bp, Homo sapiens
tggaaggcttacttc

SEQ ID NO: 485067 - DNA, 15 bp, Homo sapiens
ggaaggcttacttca

SEQ ID NO: 485068 - DNA, 15 bp, Homo sapiens
gaaggcttacttcag

SEQ ID NO: 485069 - DNA, 15 bp, Homo sapiens
aaggcttacttcagg

SEQ ID NO: 485070 - DNA, 15 bp, Homo sapiens
aggcttacttcaggg

SEQ ID NO: 485071 - DNA, 15 bp, Homo sapiens
ggcttacttcagggc

SEQ ID NO: 485072 - DNA, 15 bp, Homo sapiens
gcttacttcagggcc

SEQ ID NO: 485073 - DNA, 15 bp, Homo sapiens
cttacttcagggcct

SEQ ID NO: 485074 - DNA, 15 bp, Homo sapiens
ttacttcagggcctc

SEQ ID NO: 485075 - DNA, 15 bp, Homo sapiens
tacttcagggcctct

SEQ ID NO: 485076 - DNA, 15 bp, Homo sapiens
acttcagggcctctc

SEQ ID NO: 485077 - DNA, 15 bp, Homo sapiens
cttcagggcctctca

SEQ ID NO: 485078 - DNA, 15 bp, Homo sapiens
ttcagggcctctcaa

SEQ ID NO: 485079 - DNA, 15 bp, Homo sapiens
tcagggcctctcaat

SEQ ID NO: 485080 - DNA, 15 bp, Homo sapiens
cagggcctctcaatc

SEQ ID NO: 485081 - DNA, 15 bp, Homo sapiens
agggcctctcaatcc

SEQ ID NO: 485082 - DNA, 15 bp, Homo sapiens
gggcctctcaatccc

SEQ ID NO: 485083 - DNA, 15 bp, Homo sapiens
ggcctctcaatccca

SEQ ID NO: 485084 - DNA, 15 bp, Homo sapiens
gcctctcaatcccac

SEQ ID NO: 485085 - DNA, 15 bp, Homo sapiens
cctctcaatcccaca

SEQ ID NO: 485086 - DNA, 15 bp, Homo sapiens
ctctcaatcccacaa

SEQ ID NO: 485087 - DNA, 15 bp, Homo sapiens
tctcaatcccacaat

SEQ ID NO: 485088 - DNA, 15 bp, Homo sapiens
ctcaatcccacaatt

SEQ ID NO: 485089 - DNA, 15 bp, Homo sapiens
tcaatcccacaattt

SEQ ID NO: 485090 - DNA, 15 bp, Homo sapiens
caatcccacaatttg

SEQ ID NO: 485091 - DNA, 15 bp, Homo sapiens
aatcccacaatttgg

SEQ ID NO: 485092 - DNA, 15 bp, Homo sapiens
atcccacaatttgga

SEQ ID NO: 485093 - DNA, 15 bp, Homo sapiens
tcccacaatttggaa

SEQ ID NO: 485094 - DNA, 15 bp, Homo sapiens
cccacaatttggaaa

SEQ ID NO: 485095 - DNA, 15 bp, Homo sapiens
ccacaatttggaaag

SEQ ID NO: 485096 - DNA, 15 bp, Homo sapiens
cacaatttggaaagt

SEQ ID NO: 485097 - DNA, 15 bp, Homo sapiens
acaatttggaaagta

SEQ ID NO: 485098 - DNA, 15 bp, Homo sapiens
caatttggaaagtaa

SEQ ID NO: 485099 - DNA, 15 bp, Homo sapiens
aatttggaaagtaag

SEQ ID NO: 485100 - DNA, 15 bp, Homo sapiens
atttggaaagtaaga

SEQ ID NO: 485101 - DNA, 15 bp, Homo sapiens
tttggaaagtaagag

SEQ ID NO: 485102 - DNA, 15 bp, Homo sapiens
ttggaaagtaagagt

SEQ ID NO: 485103 - DNA, 15 bp, Homo sapiens
tggaaagtaagagtt

SEQ ID NO: 485104 - DNA, 15 bp, Homo sapiens
ggaaagtaagagttt

SEQ ID NO: 485105 - DNA, 15 bp, Homo sapiens
gaaagtaagagtttc

SEQ ID NO: 485106 - DNA, 15 bp, Homo sapiens
aaagtaagagtttcc

SEQ ID NO: 485107 - DNA, 15 bp, Homo sapiens
gggaattagaatcca

SEQ ID NO: 485108 - DNA, 15 bp, Homo sapiens
ggaattagaatccag

SEQ ID NO: 485109 - DNA, 15 bp, Homo sapiens
gaattagaatccagg

SEQ ID NO: 485110 - DNA, 15 bp, Homo sapiens
aattagaatccaggc

SEQ ID NO: 485111 - DNA, 15 bp, Homo sapiens
attagaatccaggca

SEQ ID NO: 485112 - DNA, 15 bp, Homo sapiens
ttagaatccaggcaa

SEQ ID NO: 485113 - DNA, 15 bp, Homo sapiens
tagaatccaggcaat

SEQ ID NO: 485114 - DNA, 15 bp, Homo sapiens
agaatccaggcaatc

SEQ ID NO: 485115 - DNA, 15 bp, Homo sapiens
gaatccaggcaatct

SEQ ID NO: 485116 - DNA, 15 bp, Homo sapiens
aatccaggcaatctg

SEQ ID NO: 485117 - DNA, 15 bp, Homo sapiens
atccaggcaatctga

SEQ ID NO: 485118 - DNA, 15 bp, Homo sapiens
tccaggcaatctgaa

SEQ ID NO: 485119 - DNA, 15 bp, Homo sapiens
ccaggcaatctgaat

SEQ ID NO: 485120 - DNA, 15 bp, Homo sapiens
caggcaatctgaatc

SEQ ID NO: 485121 - DNA, 15 bp, Homo sapiens
aggcaatctgaatcc

SEQ ID NO: 485122 - DNA, 15 bp, Homo sapiens
ggcaatctgaatcca

SEQ ID NO: 485123 - DNA, 15 bp, Homo sapiens
gcaatctgaatccat

SEQ ID NO: 485124 - DNA, 15 bp, Homo sapiens
caatctgaatccata

SEQ ID NO: 485125 - DNA, 15 bp, Homo sapiens
aatctgaatccataa

SEQ ID NO: 485126 - DNA, 15 bp, Homo sapiens
atctgaatccataat

SEQ ID NO: 485127 - DNA, 15 bp, Homo sapiens
tctgaatccataatc

SEQ ID NO: 485128 - DNA, 15 bp, Homo sapiens
ctgaatccataatca

SEQ ID NO: 485129 - DNA, 15 bp, Homo sapiens
tgaatccataatcat

SEQ ID NO: 485130 - DNA, 15 bp, Homo sapiens
gaatccataatcatg

SEQ ID NO: 485131 - DNA, 15 bp, Homo sapiens
aatccataatcatgc

SEQ ID NO: 485132 - DNA, 15 bp, Homo sapiens
atccataatcatgct

SEQ ID NO: 485133 - DNA, 15 bp, Homo sapiens
tccataatcatgctt

SEQ ID NO: 485134 - DNA, 15 bp, Homo sapiens
ccataatcatgcttc

SEQ ID NO: 485135 - DNA, 15 bp, Homo sapiens
cataatcatgcttct

SEQ ID NO: 485136 - DNA, 15 bp, Homo sapiens
ataatcatgcttcta

SEQ ID NO: 485137 - DNA, 15 bp, Homo sapiens
taatcatgcttctaa

SEQ ID NO: 485138 - DNA, 15 bp, Homo sapiens
aatcatgcttctaat

SEQ ID NO: 485139 - DNA, 15 bp, Homo sapiens
atcatgcttctaatc

SEQ ID NO: 485140 - DNA, 15 bp, Homo sapiens
tcatgcttctaatca

SEQ ID NO: 485141 - DNA, 15 bp, Homo sapiens
catgcttctaatcac

SEQ ID NO: 485142 - DNA, 15 bp, Homo sapiens
atgcttctaatcact

SEQ ID NO: 485143 - DNA, 15 bp, Homo sapiens
tgcttctaatcactc

SEQ ID NO: 485144 - DNA, 15 bp, Homo sapiens
gcttctaatcactct

SEQ ID NO: 485145 - DNA, 15 bp, Homo sapiens
cttctaatcactctc

SEQ ID NO: 485146 - DNA, 15 bp, Homo sapiens
ttctaatcactctct

SEQ ID NO: 485147 - DNA, 15 bp, Homo sapiens
tctaatcactctctc

SEQ ID NO: 485148 - DNA, 15 bp, Homo sapiens
ctaatcactctctca

SEQ ID NO: 485149 - DNA, 15 bp, Homo sapiens
taatcactctctcaa

SEQ ID NO: 485150 - DNA, 15 bp, Homo sapiens
aatcactctctcaat

SEQ ID NO: 485151 - DNA, 15 bp, Homo sapiens
atcactctctcaata

SEQ ID NO: 485152 - DNA, 15 bp, Homo sapiens
tcactctctcaatat

SEQ ID NO: 485153 - DNA, 15 bp, Homo sapiens
cactctctcaatatt

SEQ ID NO: 485154 - DNA, 15 bp, Homo sapiens
actctctcaatattg

SEQ ID NO: 485155 - DNA, 15 bp, Homo sapiens
ctctctcaatattgc

SEQ ID NO: 485156 - DNA, 15 bp, Homo sapiens
tctctcaatattgcc

SEQ ID NO: 485157 - DNA, 15 bp, Homo sapiens
ctctcaatattgcct

SEQ ID NO: 485158 - DNA, 15 bp, Homo sapiens
tctcaatattgcctt

SEQ ID NO: 485159 - DNA, 15 bp, Homo sapiens
ctcaatattgccttg

SEQ ID NO: 485160 - DNA, 15 bp, Homo sapiens
tcaatattgccttgg

SEQ ID NO: 485161 - DNA, 15 bp, Homo sapiens
caatattgccttgga

SEQ ID NO: 485162 - DNA, 15 bp, Homo sapiens
aatattgccttggag

SEQ ID NO: 485163 - DNA, 15 bp, Homo sapiens
atattgccttggagt

SEQ ID NO: 485164 - DNA, 15 bp, Homo sapiens
tattgccttggagta

SEQ ID NO: 485165 - DNA, 15 bp, Homo sapiens
attgccttggagtat

SEQ ID NO: 485166 - DNA, 15 bp, Homo sapiens
ttgccttggagtatg

SEQ ID NO: 485167 - DNA, 15 bp, Homo sapiens
tgccttggagtatga

SEQ ID NO: 485168 - DNA, 15 bp, Homo sapiens
gccttggagtatgag

SEQ ID NO: 485169 - DNA, 15 bp, Homo sapiens
ccttggagtatgagc

SEQ ID NO: 485170 - DNA, 15 bp, Homo sapiens
cttggagtatgagct

SEQ ID NO: 485171 - DNA, 15 bp, Homo sapiens
ttggagtatgagctg

SEQ ID NO: 485172 - DNA, 15 bp, Homo sapiens
tggagtatgagctga

SEQ ID NO: 485173 - DNA, 15 bp, Homo sapiens
ggagtatgagctgat

SEQ ID NO: 485174 - DNA, 15 bp, Homo sapiens
gagtatgagctgatt

SEQ ID NO: 485175 - DNA, 15 bp, Homo sapiens
agtatgagctgattt

SEQ ID NO: 485176 - DNA, 15 bp, Homo sapiens
gtatgagctgatttt

SEQ ID NO: 485177 - DNA, 15 bp, Homo sapiens
tatgagctgattttg

SEQ ID NO: 485178 - DNA, 15 bp, Homo sapiens
atgagctgattttga

SEQ ID NO: 485179 - DNA, 15 bp, Homo sapiens
tgagctgattttgaa

SEQ ID NO: 485180 - DNA, 15 bp, Homo sapiens
gagctgattttgaaa

SEQ ID NO: 485181 - DNA, 15 bp, Homo sapiens
agctgattttgaaat

SEQ ID NO: 485182 - DNA, 15 bp, Homo sapiens
gctgattttgaaatt

SEQ ID NO: 485183 - DNA, 15 bp, Homo sapiens
ctgattttgaaattg

SEQ ID NO: 485184 - DNA, 15 bp, Homo sapiens
tgattttgaaattgg

SEQ ID NO: 485185 - DNA, 15 bp, Homo sapiens
gattttgaaattgga

SEQ ID NO: 485186 - DNA, 15 bp, Homo sapiens
attttgaaattggat

SEQ ID NO: 485187 - DNA, 15 bp, Homo sapiens
ttttgaaattggata

SEQ ID NO: 485188 - DNA, 15 bp, Homo sapiens
tttgaaattggataa

SEQ ID NO: 485189 - DNA, 15 bp, Homo sapiens
ttgaaattggataaa

SEQ ID NO: 485190 - DNA, 15 bp, Homo sapiens
tgaaattggataaat

SEQ ID NO: 485191 - DNA, 15 bp, Homo sapiens
gaaattggataaatt

SEQ ID NO: 485192 - DNA, 15 bp, Homo sapiens
aaattggataaattt

SEQ ID NO: 485193 - DNA, 15 bp, Homo sapiens
aattggataaattta

SEQ ID NO: 485194 - DNA, 15 bp, Homo sapiens
attggataaatttac

SEQ ID NO: 485195 - DNA, 15 bp, Homo sapiens
ttggataaatttact

SEQ ID NO: 485196 - DNA, 15 bp, Homo sapiens
tggataaatttactg

SEQ ID NO: 485197 - DNA, 15 bp, Homo sapiens
ggataaatttactgt

SEQ ID NO: 485198 - DNA, 15 bp, Homo sapiens
gataaatttactgta

SEQ ID NO: 485199 - DNA, 15 bp, Homo sapiens
ataaatttactgtat

SEQ ID NO: 485200 - DNA, 15 bp, Homo sapiens
taaatttactgtatt

SEQ ID NO: 485201 - DNA, 15 bp, Homo sapiens
aaatttactgtatta

SEQ ID NO: 485202 - DNA, 15 bp, Homo sapiens
aatttactgtattag

SEQ ID NO: 485203 - DNA, 15 bp, Homo sapiens
atttactgtattaga

SEQ ID NO: 485204 - DNA, 15 bp, Homo sapiens
tttactgtattagaa

SEQ ID NO: 485205 - DNA, 15 bp, Homo sapiens
ttactgtattagaaa

SEQ ID NO: 485206 - DNA, 15 bp, Homo sapiens
tactgtattagaaac

SEQ ID NO: 485207 - DNA, 15 bp, Homo sapiens
ctgtattagaaaccc

SEQ ID NO: 485208 - DNA, 15 bp, Homo sapiens
tgtattagaaaccca

SEQ ID NO: 485209 - DNA, 15 bp, Homo sapiens
gtattagaaacccag

SEQ ID NO: 485210 - DNA, 15 bp, Homo sapiens
tattagaaacccagt

SEQ ID NO: 485211 - DNA, 15 bp, Homo sapiens
attagaaacccagtg

SEQ ID NO: 485212 - DNA, 15 bp, Homo sapiens
ttagaaacccagtgc

SEQ ID NO: 485213 - DNA, 15 bp, Homo sapiens
tagaaacccagtgct

SEQ ID NO: 485214 - DNA, 15 bp, Homo sapiens
agaaacccagtgctg

SEQ ID NO: 485215 - DNA, 15 bp, Homo sapiens
gaaacccagtgctga

SEQ ID NO: 485216 - DNA, 15 bp, Homo sapiens
aaacccagtgctgat

SEQ ID NO: 485217 - DNA, 15 bp, Homo sapiens
aacccagtgctgatg

SEQ ID NO: 485218 - DNA, 15 bp, Homo sapiens
acccagtgctgatgt

SEQ ID NO: 485219 - DNA, 15 bp, Homo sapiens
cccagtgctgatgtt

SEQ ID NO: 485220 - DNA, 15 bp, Homo sapiens
ccagtgctgatgttt

SEQ ID NO: 485221 - DNA, 15 bp, Homo sapiens
cagtgctgatgttta

SEQ ID NO: 485222 - DNA, 15 bp, Homo sapiens
agtgctgatgtttaa

SEQ ID NO: 485223 - DNA, 15 bp, Homo sapiens
gtgctgatgtttaaa

SEQ ID NO: 485224 - DNA, 15 bp, Homo sapiens
tgctgatgtttaaaa

SEQ ID NO: 485225 - DNA, 15 bp, Homo sapiens
gctgatgtttaaaat

SEQ ID NO: 485226 - DNA, 15 bp, Homo sapiens
ctgatgtttaaaata

SEQ ID NO: 485227 - DNA, 15 bp, Homo sapiens
tgatgtttaaaatat

SEQ ID NO: 485228 - DNA, 15 bp, Homo sapiens
gatgtttaaaatatg

SEQ ID NO: 485229 - DNA, 15 bp, Homo sapiens
atgtttaaaatatga

SEQ ID NO: 485230 - DNA, 15 bp, Homo sapiens
tgtttaaaatatgag

SEQ ID NO: 485231 - DNA, 15 bp, Homo sapiens
gtttaaaatatgagt

SEQ ID NO: 485232 - DNA, 15 bp, Homo sapiens
tttaaaatatgagtg

SEQ ID NO: 485233 - DNA, 15 bp, Homo sapiens
ttaaaatatgagtga

SEQ ID NO: 485234 - DNA, 15 bp, Homo sapiens
taaaatatgagtgaa

SEQ ID NO: 485235 - DNA, 15 bp, Homo sapiens
aaaatatgagtgaac

SEQ ID NO: 485236 - DNA, 15 bp, Homo sapiens
aaatatgagtgaact

SEQ ID NO: 485237 - DNA, 15 bp, Homo sapiens
aatatgagtgaacta

SEQ ID NO: 485238 - DNA, 15 bp, Homo sapiens
atatgagtgaactat

SEQ ID NO: 485239 - DNA, 15 bp, Homo sapiens
tatgagtgaactatg

SEQ ID NO: 485240 - DNA, 15 bp, Homo sapiens
atgagtgaactatgc

SEQ ID NO: 485241 - DNA, 15 bp, Homo sapiens
tgagtgaactatgct

SEQ ID NO: 485242 - DNA, 15 bp, Homo sapiens
gagtgaactatgctt

SEQ ID NO: 485243 - DNA, 15 bp, Homo sapiens
agtgaactatgctta

SEQ ID NO: 485244 - DNA, 15 bp, Homo sapiens
gtgaactatgcttat

SEQ ID NO: 485245 - DNA, 15 bp, Homo sapiens
tgaactatgcttatg

SEQ ID NO: 485246 - DNA, 15 bp, Homo sapiens
gaactatgcttatga

SEQ ID NO: 485247 - DNA, 15 bp, Homo sapiens
aactatgcttatgaa

SEQ ID NO: 485248 - DNA, 15 bp, Homo sapiens
actatgcttatgaat

SEQ ID NO: 485249 - DNA, 15 bp, Homo sapiens
ctatgcttatgaatt

SEQ ID NO: 485250 - DNA, 15 bp, Homo sapiens
tatgcttatgaattc

SEQ ID NO: 485251 - DNA, 15 bp, Homo sapiens
atgcttatgaattca

SEQ ID NO: 485252 - DNA, 15 bp, Homo sapiens
tgcttatgaattcac

SEQ ID NO: 485253 - DNA, 15 bp, Homo sapiens
gcttatgaattcact

SEQ ID NO: 485254 - DNA, 15 bp, Homo sapiens
cttatgaattcactt

SEQ ID NO: 485255 - DNA, 15 bp, Homo sapiens
ttatgaattcactta

SEQ ID NO: 485256 - DNA, 15 bp, Homo sapiens
tatgaattcacttaa

SEQ ID NO: 485257 - DNA, 15 bp, Homo sapiens
atgaattcacttaac

SEQ ID NO: 485258 - DNA, 15 bp, Homo sapiens
tgaattcacttaaca

SEQ ID NO: 485259 - DNA, 15 bp, Homo sapiens
gaattcacttaacat

SEQ ID NO: 485260 - DNA, 15 bp, Homo sapiens
aattcacttaacatt

SEQ ID NO: 485261 - DNA, 15 bp, Homo sapiens
attcacttaacatta

SEQ ID NO: 485262 - DNA, 15 bp, Homo sapiens
ttcacttaacattaa

SEQ ID NO: 485263 - DNA, 15 bp, Homo sapiens
tcacttaacattaaa

SEQ ID NO: 485264 - DNA, 15 bp, Homo sapiens
cacttaacattaaaa

SEQ ID NO: 485265 - DNA, 15 bp, Homo sapiens
acttaacattaaaac

SEQ ID NO: 485266 - DNA, 15 bp, Homo sapiens
cttaacattaaaaca

SEQ ID NO: 485267 - DNA, 15 bp, Homo sapiens
taacattaaaacaac

SEQ ID NO: 485268 - DNA, 15 bp, Homo sapiens
aacattaaaacaaca

SEQ ID NO: 485269 - DNA, 15 bp, Homo sapiens
acattaaaacaacag

SEQ ID NO: 485270 - DNA, 15 bp, Homo sapiens
cattaaaacaacaga

SEQ ID NO: 485271 - DNA, 15 bp, Homo sapiens
attaaaacaacagaa

SEQ ID NO: 485272 - DNA, 15 bp, Homo sapiens
ttaaaacaacagaaa

SEQ ID NO: 485273 - DNA, 15 bp, Homo sapiens
taaaacaacagaaaa

SEQ ID NO: 485274 - DNA, 15 bp, Homo sapiens
aaaacaacagaaaaa

SEQ ID NO: 485275 - DNA, 15 bp, Homo sapiens
aaacaacagaaaaat

SEQ ID NO: 485276 - DNA, 15 bp, Homo sapiens
aacaacagaaaaatt

SEQ ID NO: 485277 - DNA, 15 bp, Homo sapiens
acaacagaaaaattg

SEQ ID NO: 485278 - DNA, 15 bp, Homo sapiens
caacagaaaaattga

SEQ ID NO: 485279 - DNA, 15 bp, Homo sapiens
aacagaaaaattgag

SEQ ID NO: 485280 - DNA, 15 bp, Homo sapiens
acagaaaaattgagg

SEQ ID NO: 485281 - DNA, 15 bp, Homo sapiens
cagaaaaattgaggg

SEQ ID NO: 485282 - DNA, 15 bp, Homo sapiens
agaaaaattgaggga

SEQ ID NO: 485283 - DNA, 15 bp, Homo sapiens
gaaaaattgagggat

SEQ ID NO: 485284 - DNA, 15 bp, Homo sapiens
aaaaattgagggata

SEQ ID NO: 485285 - DNA, 15 bp, Homo sapiens
aaaattgagggataa

SEQ ID NO: 485286 - DNA, 15 bp, Homo sapiens
aaattgagggataaa

SEQ ID NO: 485287 - DNA, 15 bp, Homo sapiens
aattgagggataaaa

SEQ ID NO: 485288 - DNA, 15 bp, Homo sapiens
attgagggataaaaa

SEQ ID NO: 485289 - DNA, 15 bp, Homo sapiens
ttgagggataaaaat

SEQ ID NO: 485290 - DNA, 15 bp, Homo sapiens
tgagggataaaaatg

SEQ ID NO: 485291 - DNA, 15 bp, Homo sapiens
gagggataaaaatgg

SEQ ID NO: 485292 - DNA, 15 bp, Homo sapiens
agggataaaaatggt

SEQ ID NO: 485293 - DNA, 15 bp, Homo sapiens
gggataaaaatggtg

SEQ ID NO: 485294 - DNA, 15 bp, Homo sapiens
ggataaaaatggtgt

SEQ ID NO: 485295 - DNA, 15 bp, Homo sapiens
gataaaaatggtgtt

SEQ ID NO: 485296 - DNA, 15 bp, Homo sapiens
ataaaaatggtgttg

SEQ ID NO: 485297 - DNA, 15 bp, Homo sapiens
taaaaatggtgttga

SEQ ID NO: 485298 - DNA, 15 bp, Homo sapiens
aaaaatggtgttgat

SEQ ID NO: 485299 - DNA, 15 bp, Homo sapiens
aaaatggtgttgata

SEQ ID NO: 485300 - DNA, 15 bp, Homo sapiens
aaatggtgttgataa

SEQ ID NO: 485301 - DNA, 15 bp, Homo sapiens
aatggtgttgataaa

SEQ ID NO: 485302 - DNA, 15 bp, Homo sapiens
atggtgttgataaat

SEQ ID NO: 485303 - DNA, 15 bp, Homo sapiens
tggtgttgataaatg

SEQ ID NO: 485304 - DNA, 15 bp, Homo sapiens
ggtgttgataaatga

SEQ ID NO: 485305 - DNA, 15 bp, Homo sapiens
gtgttgataaatgag

SEQ ID NO: 485306 - DNA, 15 bp, Homo sapiens
tgttgataaatgagt

SEQ ID NO: 485307 - DNA, 15 bp, Homo sapiens
gttgataaatgagtc

SEQ ID NO: 485308 - DNA, 15 bp, Homo sapiens
ttgataaatgagtct

SEQ ID NO: 485309 - DNA, 15 bp, Homo sapiens
tgataaatgagtctg

SEQ ID NO: 485310 - DNA, 15 bp, Homo sapiens
gataaatgagtctgg

SEQ ID NO: 485311 - DNA, 15 bp, Homo sapiens
ataaatgagtctggc

SEQ ID NO: 485312 - DNA, 15 bp, Homo sapiens
taaatgagtctggca

SEQ ID NO: 485313 - DNA, 15 bp, Homo sapiens
aaatgagtctggcag

SEQ ID NO: 485314 - DNA, 15 bp, Homo sapiens
aatgagtctggcagc

SEQ ID NO: 485315 - DNA, 15 bp, Homo sapiens
atgagtctggcagca

SEQ ID NO: 485316 - DNA, 15 bp, Homo sapiens
tgagtctggcagcat

SEQ ID NO: 485317 - DNA, 15 bp, Homo sapiens
gagtctggcagcata

SEQ ID NO: 485318 - DNA, 15 bp, Homo sapiens
agtctggcagcataa

SEQ ID NO: 485319 - DNA, 15 bp, Homo sapiens
gtctggcagcataac

SEQ ID NO: 485320 - DNA, 15 bp, Homo sapiens
tctggcagcataacc

SEQ ID NO: 485321 - DNA, 15 bp, Homo sapiens
ctggcagcataacca

SEQ ID NO: 485322 - DNA, 15 bp, Homo sapiens
tggcagcataaccaa

SEQ ID NO: 485323 - DNA, 15 bp, Homo sapiens
ggcagcataaccaag

SEQ ID NO: 485324 - DNA, 15 bp, Homo sapiens
gcagcataaccaagt

SEQ ID NO: 485325 - DNA, 15 bp, Homo sapiens
cagcataaccaagtg

SEQ ID NO: 485326 - DNA, 15 bp, Homo sapiens
agcataaccaagtgg

SEQ ID NO: 485327 - DNA, 15 bp, Homo sapiens
gcataaccaagtgga

SEQ ID NO: 485328 - DNA, 15 bp, Homo sapiens
cataaccaagtggat

SEQ ID NO: 485329 - DNA, 15 bp, Homo sapiens
ataaccaagtggatt

SEQ ID NO: 485330 - DNA, 15 bp, Homo sapiens
taaccaagtggattc

SEQ ID NO: 485331 - DNA, 15 bp, Homo sapiens
aaccaagtggattct

SEQ ID NO: 485332 - DNA, 15 bp, Homo sapiens
accaagtggattctt

SEQ ID NO: 485333 - DNA, 15 bp, Homo sapiens
ccaagtggattcttc

SEQ ID NO: 485334 - DNA, 15 bp, Homo sapiens
caagtggattcttca

SEQ ID NO: 485335 - DNA, 15 bp, Homo sapiens
aagtggattcttcaa

SEQ ID NO: 485336 - DNA, 15 bp, Homo sapiens
agtggattcttcaag

SEQ ID NO: 485337 - DNA, 15 bp, Homo sapiens
gtggattcttcaagg

SEQ ID NO: 485338 - DNA, 15 bp, Homo sapiens
tggattcttcaaggt

SEQ ID NO: 485339 - DNA, 15 bp, Homo sapiens
ggattcttcaaggtg

SEQ ID NO: 485340 - DNA, 15 bp, Homo sapiens
gattcttcaaggtgt

SEQ ID NO: 485341 - DNA, 15 bp, Homo sapiens
attcttcaaggtgtc

SEQ ID NO: 485342 - DNA, 15 bp, Homo sapiens
ttcttcaaggtgtcc

SEQ ID NO: 485343 - DNA, 15 bp, Homo sapiens
tcttcaaggtgtcca

SEQ ID NO: 485344 - DNA, 15 bp, Homo sapiens
cttcaaggtgtccaa

SEQ ID NO: 485345 - DNA, 15 bp, Homo sapiens
ttcaaggtgtccaag

SEQ ID NO: 485346 - DNA, 15 bp, Homo sapiens
tcaaggtgtccaagc

SEQ ID NO: 485347 - DNA, 15 bp, Homo sapiens
caaggtgtccaagcg

SEQ ID NO: 485348 - DNA, 15 bp, Homo sapiens
aaggtgtccaagcgg

SEQ ID NO: 485349 - DNA, 15 bp, Homo sapiens
aggtgtccaagcgga

SEQ ID NO: 485350 - DNA, 15 bp, Homo sapiens
ggtgtccaagcggaa

SEQ ID NO: 485351 - DNA, 15 bp, Homo sapiens
gtgtccaagcggaaa

SEQ ID NO: 485352 - DNA, 15 bp, Homo sapiens
tgtccaagcggaaag

SEQ ID NO: 485353 - DNA, 15 bp, Homo sapiens
gtccaagcggaaaga

SEQ ID NO: 485354 - DNA, 15 bp, Homo sapiens
tccaagcggaaagag

SEQ ID NO: 485355 - DNA, 15 bp, Homo sapiens
ccaagcggaaagaga

SEQ ID NO: 485356 - DNA, 15 bp, Homo sapiens
caagcggaaagagaa

SEQ ID NO: 485357 - DNA, 15 bp, Homo sapiens
aagcggaaagagaag

SEQ ID NO: 485358 - DNA, 15 bp, Homo sapiens
agcggaaagagaagg

SEQ ID NO: 485359 - DNA, 15 bp, Homo sapiens
gcggaaagagaagga

SEQ ID NO: 485360 - DNA, 15 bp, Homo sapiens
cggaaagagaaggac

SEQ ID NO: 485361 - DNA, 15 bp, Homo sapiens
ggaaagagaaggacc

SEQ ID NO: 485362 - DNA, 15 bp, Homo sapiens
gaaagagaaggacca

SEQ ID NO: 485363 - DNA, 15 bp, Homo sapiens
aaagagaaggaccaa

SEQ ID NO: 485364 - DNA, 15 bp, Homo sapiens
aagagaaggaccaaa

SEQ ID NO: 485365 - DNA, 15 bp, Homo sapiens
agagaaggaccaaag

SEQ ID NO: 485366 - DNA, 15 bp, Homo sapiens
gagaaggaccaaagc

SEQ ID NO: 485367 - DNA, 15 bp, Homo sapiens
agaaggaccaaagcc

SEQ ID NO: 485368 - DNA, 15 bp, Homo sapiens
gaaggaccaaagccc

SEQ ID NO: 485369 - DNA, 15 bp, Homo sapiens
aaggaccaaagcccc

SEQ ID NO: 485370 - DNA, 15 bp, Homo sapiens
aggaccaaagccccc

SEQ ID NO: 485371 - DNA, 15 bp, Homo sapiens
ggaccaaagccccca

SEQ ID NO: 485372 - DNA, 15 bp, Homo sapiens
gaccaaagcccccac

SEQ ID NO: 485373 - DNA, 15 bp, Homo sapiens
accaaagcccccacc

SEQ ID NO: 485374 - DNA, 15 bp, Homo sapiens
ccaaagcccccacca

SEQ ID NO: 485375 - DNA, 15 bp, Homo sapiens
caaagcccccaccaa

SEQ ID NO: 485376 - DNA, 15 bp, Homo sapiens
aaagcccccaccaag

SEQ ID NO: 485377 - DNA, 15 bp, Homo sapiens
aagcccccaccaagc

SEQ ID NO: 485378 - DNA, 15 bp, Homo sapiens
agcccccaccaagct

SEQ ID NO: 485379 - DNA, 15 bp, Homo sapiens
gcccccaccaagctg

SEQ ID NO: 485380 - DNA, 15 bp, Homo sapiens
cccccaccaagctga

SEQ ID NO: 485381 - DNA, 15 bp, Homo sapiens
ccccaccaagctgat

SEQ ID NO: 485382 - DNA, 15 bp, Homo sapiens
cccaccaagctgatg

SEQ ID NO: 485383 - DNA, 15 bp, Homo sapiens
ccaccaagctgatgc

SEQ ID NO: 485384 - DNA, 15 bp, Homo sapiens
caccaagctgatgct

SEQ ID NO: 485385 - DNA, 15 bp, Homo sapiens
accaagctgatgcta

SEQ ID NO: 485386 - DNA, 15 bp, Homo sapiens
ccaagctgatgctaa

SEQ ID NO: 485387 - DNA, 15 bp, Homo sapiens
caagctgatgctaaa

SEQ ID NO: 485388 - DNA, 15 bp, Homo sapiens
aagctgatgctaaaa

SEQ ID NO: 485389 - DNA, 15 bp, Homo sapiens
agctgatgctaaaat

SEQ ID NO: 485390 - DNA, 15 bp, Homo sapiens
gctgatgctaaaatg

SEQ ID NO: 485391 - DNA, 15 bp, Homo sapiens
ctgatgctaaaatgt

SEQ ID NO: 485392 - DNA, 15 bp, Homo sapiens
tgatgctaaaatgta

SEQ ID NO: 485393 - DNA, 15 bp, Homo sapiens
gatgctaaaatgtat

SEQ ID NO: 485394 - DNA, 15 bp, Homo sapiens
atgctaaaatgtatg

SEQ ID NO: 485395 - DNA, 15 bp, Homo sapiens
tgctaaaatgtatgg

SEQ ID NO: 485396 - DNA, 15 bp, Homo sapiens
gctaaaatgtatgga

SEQ ID NO: 485397 - DNA, 15 bp, Homo sapiens
ctaaaatgtatggaa

SEQ ID NO: 485398 - DNA, 15 bp, Homo sapiens
taaaatgtatggaaa

SEQ ID NO: 485399 - DNA, 15 bp, Homo sapiens
aaaatgtatggaaaa

SEQ ID NO: 485400 - DNA, 15 bp, Homo sapiens
aaatgtatggaaaac

SEQ ID NO: 485401 - DNA, 15 bp, Homo sapiens
aatgtatggaaaaca

SEQ ID NO: 485402 - DNA, 15 bp, Homo sapiens
atgtatggaaaacat

SEQ ID NO: 485403 - DNA, 15 bp, Homo sapiens
tgtatggaaaacatc

SEQ ID NO: 485404 - DNA, 15 bp, Homo sapiens
gtatggaaaacatct

SEQ ID NO: 485405 - DNA, 15 bp, Homo sapiens
tatggaaaacatctg

SEQ ID NO: 485406 - DNA, 15 bp, Homo sapiens
atggaaaacatctga

SEQ ID NO: 485407 - DNA, 15 bp, Homo sapiens
tggaaaacatctgaa

SEQ ID NO: 485408 - DNA, 15 bp, Homo sapiens
ggaaaacatctgaag

SEQ ID NO: 485409 - DNA, 15 bp, Homo sapiens
gaaaacatctgaagg

SEQ ID NO: 485410 - DNA, 15 bp, Homo sapiens
aaaacatctgaaggc

SEQ ID NO: 485411 - DNA, 15 bp, Homo sapiens
aaacatctgaaggca

SEQ ID NO: 485412 - DNA, 15 bp, Homo sapiens
aacatctgaaggcaa

SEQ ID NO: 485413 - DNA, 15 bp, Homo sapiens
acatctgaaggcaaa

SEQ ID NO: 485414 - DNA, 15 bp, Homo sapiens
catctgaaggcaaag

SEQ ID NO: 485415 - DNA, 15 bp, Homo sapiens
atctgaaggcaaaga

SEQ ID NO: 485416 - DNA, 15 bp, Homo sapiens
tctgaaggcaaagac

SEQ ID NO: 485417 - DNA, 15 bp, Homo sapiens
ctgaaggcaaagact

SEQ ID NO: 485418 - DNA, 15 bp, Homo sapiens
tgaaggcaaagactt

SEQ ID NO: 485419 - DNA, 15 bp, Homo sapiens
gaaggcaaagacttc

SEQ ID NO: 485420 - DNA, 15 bp, Homo sapiens
aaggcaaagacttct

SEQ ID NO: 485421 - DNA, 15 bp, Homo sapiens
aggcaaagacttcta

SEQ ID NO: 485422 - DNA, 15 bp, Homo sapiens
ggcaaagacttctat

SEQ ID NO: 485423 - DNA, 15 bp, Homo sapiens
gcaaagacttctata

SEQ ID NO: 485424 - DNA, 15 bp, Homo sapiens
caaagacttctatat

SEQ ID NO: 485425 - DNA, 15 bp, Homo sapiens
aaagacttctatatg

SEQ ID NO: 485426 - DNA, 15 bp, Homo sapiens
aagacttctatatga

SEQ ID NO: 485427 - DNA, 15 bp, Homo sapiens
agacttctatatgat

SEQ ID NO: 485428 - DNA, 15 bp, Homo sapiens
gacttctatatgatt

SEQ ID NO: 485429 - DNA, 15 bp, Homo sapiens
acttctatatgattt

SEQ ID NO: 485430 - DNA, 15 bp, Homo sapiens
cttctatatgattta

SEQ ID NO: 485431 - DNA, 15 bp, Homo sapiens
ttctatatgatttaa

SEQ ID NO: 485432 - DNA, 15 bp, Homo sapiens
tctatatgatttaat

SEQ ID NO: 485433 - DNA, 15 bp, Homo sapiens
ctatatgatttaatt

SEQ ID NO: 485434 - DNA, 15 bp, Homo sapiens
tatatgatttaatta

SEQ ID NO: 485435 - DNA, 15 bp, Homo sapiens
atatgatttaattat

SEQ ID NO: 485436 - DNA, 15 bp, Homo sapiens
tatgatttaattatc

SEQ ID NO: 485437 - DNA, 15 bp, Homo sapiens
atgatttaattatcc

SEQ ID NO: 485438 - DNA, 15 bp, Homo sapiens
tgatttaattatcca

SEQ ID NO: 485439 - DNA, 15 bp, Homo sapiens
gatttaattatccat

SEQ ID NO: 485440 - DNA, 15 bp, Homo sapiens
atttaattatccatg

SEQ ID NO: 485441 - DNA, 15 bp, Homo sapiens
tttaattatccatgg

SEQ ID NO: 485442 - DNA, 15 bp, Homo sapiens
ttaattatccatggt

SEQ ID NO: 485443 - DNA, 15 bp, Homo sapiens
taattatccatggtg

SEQ ID NO: 485444 - DNA, 15 bp, Homo sapiens
aattatccatggtga

SEQ ID NO: 485445 - DNA, 15 bp, Homo sapiens
attatccatggtgag

SEQ ID NO: 485446 - DNA, 15 bp, Homo sapiens
ttatccatggtgagg

SEQ ID NO: 485447 - DNA, 15 bp, Homo sapiens
tatccatggtgaggg

SEQ ID NO: 485448 - DNA, 15 bp, Homo sapiens
atccatggtgagggc

SEQ ID NO: 485449 - DNA, 15 bp, Homo sapiens
tccatggtgagggcg

SEQ ID NO: 485450 - DNA, 15 bp, Homo sapiens
ccatggtgagggcgg

SEQ ID NO: 485451 - DNA, 15 bp, Homo sapiens
catggtgagggcggg

SEQ ID NO: 485452 - DNA, 15 bp, Homo sapiens
atggtgagggcgggg

SEQ ID NO: 485453 - DNA, 15 bp, Homo sapiens
tggtgagggcgggga

SEQ ID NO: 485454 - DNA, 15 bp, Homo sapiens
ggtgagggcggggaa

SEQ ID NO: 485455 - DNA, 15 bp, Homo sapiens
gtgagggcggggaag

SEQ ID NO: 485456 - DNA, 15 bp, Homo sapiens
tgagggcggggaagt

SEQ ID NO: 485457 - DNA, 15 bp, Homo sapiens
gagggcggggaagtt

SEQ ID NO: 485458 - DNA, 15 bp, Homo sapiens
agggcggggaagtta

SEQ ID NO: 485459 - DNA, 15 bp, Homo sapiens
gggcggggaagttaa

SEQ ID NO: 485460 - DNA, 15 bp, Homo sapiens
ggcggggaagttaaa

SEQ ID NO: 485461 - DNA, 15 bp, Homo sapiens
gcggggaagttaaaa

SEQ ID NO: 485462 - DNA, 15 bp, Homo sapiens
cggggaagttaaaaa

SEQ ID NO: 485463 - DNA, 15 bp, Homo sapiens
ggggaagttaaaaag

SEQ ID NO: 485464 - DNA, 15 bp, Homo sapiens
gggaagttaaaaagg

SEQ ID NO: 485465 - DNA, 15 bp, Homo sapiens
ggaagttaaaaagga

SEQ ID NO: 485466 - DNA, 15 bp, Homo sapiens
gaagttaaaaaggaa

SEQ ID NO: 485467 - DNA, 15 bp, Homo sapiens
aagttaaaaaggaaa

SEQ ID NO: 485468 - DNA, 15 bp, Homo sapiens
agttaaaaaggaaat

SEQ ID NO: 485469 - DNA, 15 bp, Homo sapiens
gttaaaaaggaaatg

SEQ ID NO: 485470 - DNA, 15 bp, Homo sapiens
ttaaaaaggaaatgt

SEQ ID NO: 485471 - DNA, 15 bp, Homo sapiens
taaaaaggaaatgtt

SEQ ID NO: 485472 - DNA, 15 bp, Homo sapiens
aaaaaggaaatgttt

SEQ ID NO: 485473 - DNA, 15 bp, Homo sapiens
aaaaggaaatgtttt

SEQ ID NO: 485474 - DNA, 15 bp, Homo sapiens
aaaggaaatgttttt

SEQ ID NO: 485475 - DNA, 15 bp, Homo sapiens
aaggaaatgtttttc

SEQ ID NO: 485476 - DNA, 15 bp, Homo sapiens
aggaaatgtttttcc

SEQ ID NO: 485477 - DNA, 15 bp, Homo sapiens
ggaaatgtttttcct

SEQ ID NO: 485478 - DNA, 15 bp, Homo sapiens
gaaatgtttttcctt

SEQ ID NO: 485479 - DNA, 15 bp, Homo sapiens
aaatgtttttcctta

SEQ ID NO: 485480 - DNA, 15 bp, Homo sapiens
aatgtttttccttat

SEQ ID NO: 485481 - DNA, 15 bp, Homo sapiens
atgtttttccttatg

SEQ ID NO: 485482 - DNA, 15 bp, Homo sapiens
tgtttttccttatga

SEQ ID NO: 485483 - DNA, 15 bp, Homo sapiens
gtttttccttatgat

SEQ ID NO: 485484 - DNA, 15 bp, Homo sapiens
tttttccttatgatt

SEQ ID NO: 485485 - DNA, 15 bp, Homo sapiens
ttttccttatgatta

SEQ ID NO: 485486 - DNA, 15 bp, Homo sapiens
tttccttatgattat

SEQ ID NO: 485487 - DNA, 15 bp, Homo sapiens
ttccttatgattatt

SEQ ID NO: 485488 - DNA, 15 bp, Homo sapiens
tccttatgattattt

SEQ ID NO: 485489 - DNA, 15 bp, Homo sapiens
ccttatgattatttg

SEQ ID NO: 485490 - DNA, 15 bp, Homo sapiens
cttatgattatttga

SEQ ID NO: 485491 - DNA, 15 bp, Homo sapiens
ttatgattatttgaa

SEQ ID NO: 485492 - DNA, 15 bp, Homo sapiens
tatgattatttgaat

SEQ ID NO: 485493 - DNA, 15 bp, Homo sapiens
atgattatttgaatc

SEQ ID NO: 485494 - DNA, 15 bp, Homo sapiens
tgattatttgaatcc

SEQ ID NO: 485495 - DNA, 15 bp, Homo sapiens
gattatttgaatcct

SEQ ID NO: 485496 - DNA, 15 bp, Homo sapiens
attatttgaatcctt

SEQ ID NO: 485497 - DNA, 15 bp, Homo sapiens
ttatttgaatccttt

SEQ ID NO: 485498 - DNA, 15 bp, Homo sapiens
tatttgaatcctttc

SEQ ID NO: 485499 - DNA, 15 bp, Homo sapiens
atttgaatcctttct

SEQ ID NO: 485500 - DNA, 15 bp, Homo sapiens
tttgaatcctttctc

SEQ ID NO: 485501 - DNA, 15 bp, Homo sapiens
ttgaatcctttctct

SEQ ID NO: 485502 - DNA, 15 bp, Homo sapiens
tgaatcctttctctg

SEQ ID NO: 485503 - DNA, 15 bp, Homo sapiens
gaatcctttctctgc

SEQ ID NO: 485504 - DNA, 15 bp, Homo sapiens
aatcctttctctgct

SEQ ID NO: 485505 - DNA, 15 bp, Homo sapiens
atcctttctctgctt

SEQ ID NO: 485506 - DNA, 15 bp, Homo sapiens
tcctttctctgcttt

SEQ ID NO: 485507 - DNA, 15 bp, Homo sapiens
cctttctctgcttta

SEQ ID NO: 485508 - DNA, 15 bp, Homo sapiens
ctttctctgctttaa

SEQ ID NO: 485509 - DNA, 15 bp, Homo sapiens
tttctctgctttaac

SEQ ID NO: 485510 - DNA, 15 bp, Homo sapiens
ttctctgctttaacc

SEQ ID NO: 485511 - DNA, 15 bp, Homo sapiens
tctctgctttaacct

SEQ ID NO: 485512 - DNA, 15 bp, Homo sapiens
ctctgctttaacctc

SEQ ID NO: 485513 - DNA, 15 bp, Homo sapiens
tctgctttaacctct

SEQ ID NO: 485514 - DNA, 15 bp, Homo sapiens
ctgctttaacctctg

SEQ ID NO: 485515 - DNA, 15 bp, Homo sapiens
tgctttaacctctga

SEQ ID NO: 485516 - DNA, 15 bp, Homo sapiens
gctttaacctctgaa

SEQ ID NO: 485517 - DNA, 15 bp, Homo sapiens
ctttaacctctgaat

SEQ ID NO: 485518 - DNA, 15 bp, Homo sapiens
tttaacctctgaatg

SEQ ID NO: 485519 - DNA, 15 bp, Homo sapiens
ttaacctctgaatgt

SEQ ID NO: 485520 - DNA, 15 bp, Homo sapiens
taacctctgaatgtg

SEQ ID NO: 485521 - DNA, 15 bp, Homo sapiens
aacctctgaatgtgg

SEQ ID NO: 485522 - DNA, 15 bp, Homo sapiens
acctctgaatgtggt

SEQ ID NO: 485523 - DNA, 15 bp, Homo sapiens
cctctgaatgtggtt

SEQ ID NO: 485524 - DNA, 15 bp, Homo sapiens
ctctgaatgtggttc

SEQ ID NO: 485525 - DNA, 15 bp, Homo sapiens
tctgaatgtggttcc

SEQ ID NO: 485526 - DNA, 15 bp, Homo sapiens
ctgaatgtggttcca

SEQ ID NO: 485527 - DNA, 15 bp, Homo sapiens
tgaatgtggttccag

SEQ ID NO: 485528 - DNA, 15 bp, Homo sapiens
gaatgtggttccagc

SEQ ID NO: 485529 - DNA, 15 bp, Homo sapiens
aatgtggttccagcc

SEQ ID NO: 485530 - DNA, 15 bp, Homo sapiens
atgtggttccagcct

SEQ ID NO: 485531 - DNA, 15 bp, Homo sapiens
tgtggttccagcctg

SEQ ID NO: 485532 - DNA, 15 bp, Homo sapiens
gtggttccagcctga

SEQ ID NO: 485533 - DNA, 15 bp, Homo sapiens
tggttccagcctgaa

SEQ ID NO: 485534 - DNA, 15 bp, Homo sapiens
ggttccagcctgaat

SEQ ID NO: 485535 - DNA, 15 bp, Homo sapiens
gttccagcctgaatc

SEQ ID NO: 485536 - DNA, 15 bp, Homo sapiens
ttccagcctgaatct

SEQ ID NO: 485537 - DNA, 15 bp, Homo sapiens
tccagcctgaatctg

SEQ ID NO: 485538 - DNA, 15 bp, Homo sapiens
ccagcctgaatctga

SEQ ID NO: 485539 - DNA, 15 bp, Homo sapiens
cagcctgaatctgat

SEQ ID NO: 485540 - DNA, 15 bp, Homo sapiens
agcctgaatctgatt

SEQ ID NO: 485541 - DNA, 15 bp, Homo sapiens
gcctgaatctgattc

SEQ ID NO: 485542 - DNA, 15 bp, Homo sapiens
cctgaatctgattcc

SEQ ID NO: 485543 - DNA, 15 bp, Homo sapiens
ctgaatctgattccc

SEQ ID NO: 485544 - DNA, 15 bp, Homo sapiens
tgaatctgattcccg

SEQ ID NO: 485545 - DNA, 15 bp, Homo sapiens
gaatctgattcccga

SEQ ID NO: 485546 - DNA, 15 bp, Homo sapiens
aatctgattcccgaa

SEQ ID NO: 485547 - DNA, 15 bp, Homo sapiens
atctgattcccgaat

SEQ ID NO: 485548 - DNA, 15 bp, Homo sapiens
tctgattcccgaatc

SEQ ID NO: 485549 - DNA, 15 bp, Homo sapiens
ctgattcccgaatca

SEQ ID NO: 485550 - DNA, 15 bp, Homo sapiens
tgattcccgaatcaa

SEQ ID NO: 485551 - DNA, 15 bp, Homo sapiens
gattcccgaatcaat

SEQ ID NO: 485552 - DNA, 15 bp, Homo sapiens
attcccgaatcaatg

SEQ ID NO: 485553 - DNA, 15 bp, Homo sapiens
ttcccgaatcaatgg

SEQ ID NO: 485554 - DNA, 15 bp, Homo sapiens
tcccgaatcaatggt

SEQ ID NO: 485555 - DNA, 15 bp, Homo sapiens
cccgaatcaatggtg

SEQ ID NO: 485556 - DNA, 15 bp, Homo sapiens
ccgaatcaatggtgt

SEQ ID NO: 485557 - DNA, 15 bp, Homo sapiens
cgaatcaatggtgtt

SEQ ID NO: 485558 - DNA, 15 bp, Homo sapiens
gaatcaatggtgttt

SEQ ID NO: 485559 - DNA, 15 bp, Homo sapiens
aatcaatggtgtttc

SEQ ID NO: 485560 - DNA, 15 bp, Homo sapiens
atcaatggtgtttcc

SEQ ID NO: 485561 - DNA, 15 bp, Homo sapiens
tcaatggtgtttccc

SEQ ID NO: 485562 - DNA, 15 bp, Homo sapiens
caatggtgtttcccc

SEQ ID NO: 485563 - DNA, 15 bp, Homo sapiens
aatggtgtttcccca

SEQ ID NO: 485564 - DNA, 15 bp, Homo sapiens
atggtgtttccccat

SEQ ID NO: 485565 - DNA, 15 bp, Homo sapiens
tggtgtttccccatg

SEQ ID NO: 485566 - DNA, 15 bp, Homo sapiens
ggtgtttccccatgg

SEQ ID NO: 485567 - DNA, 15 bp, Homo sapiens
gtgtttccccatggg

SEQ ID NO: 485568 - DNA, 15 bp, Homo sapiens
tgtttccccatgggc

SEQ ID NO: 485569 - DNA, 15 bp, Homo sapiens
gtttccccatgggct

SEQ ID NO: 485570 - DNA, 15 bp, Homo sapiens
tttccccatgggctt

SEQ ID NO: 485571 - DNA, 15 bp, Homo sapiens
ttccccatgggcttc

SEQ ID NO: 485572 - DNA, 15 bp, Homo sapiens
tccccatgggcttct

SEQ ID NO: 485573 - DNA, 15 bp, Homo sapiens
ccccatgggcttctc

SEQ ID NO: 485574 - DNA, 15 bp, Homo sapiens
cccatgggcttctcc

SEQ ID NO: 485575 - DNA, 15 bp, Homo sapiens
ccatgggcttctcct

SEQ ID NO: 485576 - DNA, 15 bp, Homo sapiens
catgggcttctcctc

SEQ ID NO: 485577 - DNA, 15 bp, Homo sapiens
atgggcttctcctca

SEQ ID NO: 485578 - DNA, 15 bp, Homo sapiens
tgggcttctcctcag

SEQ ID NO: 485579 - DNA, 15 bp, Homo sapiens
gggcttctcctcagc

SEQ ID NO: 485580 - DNA, 15 bp, Homo sapiens
ggcttctcctcagca

SEQ ID NO: 485581 - DNA, 15 bp, Homo sapiens
gcttctcctcagcat

SEQ ID NO: 485582 - DNA, 15 bp, Homo sapiens
cttctcctcagcatt

SEQ ID NO: 485583 - DNA, 15 bp, Homo sapiens
ttctcctcagcattc

SEQ ID NO: 485584 - DNA, 15 bp, Homo sapiens
tctcctcagcattct

SEQ ID NO: 485585 - DNA, 15 bp, Homo sapiens
ctcctcagcattctg

SEQ ID NO: 485586 - DNA, 15 bp, Homo sapiens
tcctcagcattctgc

SEQ ID NO: 485587 - DNA, 15 bp, Homo sapiens
cctcagcattctgca

SEQ ID NO: 485588 - DNA, 15 bp, Homo sapiens
ctcagcattctgcac

SEQ ID NO: 485589 - DNA, 15 bp, Homo sapiens
tcagcattctgcact

SEQ ID NO: 485590 - DNA, 15 bp, Homo sapiens
cagcattctgcactg

SEQ ID NO: 485591 - DNA, 15 bp, Homo sapiens
agcattctgcactga

SEQ ID NO: 485592 - DNA, 15 bp, Homo sapiens
gcattctgcactgag

SEQ ID NO: 485593 - DNA, 15 bp, Homo sapiens
cattctgcactgagc

SEQ ID NO: 485594 - DNA, 15 bp, Homo sapiens
attctgcactgagct

SEQ ID NO: 485595 - DNA, 15 bp, Homo sapiens
ttctgcactgagcta

SEQ ID NO: 485596 - DNA, 15 bp, Homo sapiens
tctgcactgagctac

SEQ ID NO: 485597 - DNA, 15 bp, Homo sapiens
ctgcactgagctact

SEQ ID NO: 485598 - DNA, 15 bp, Homo sapiens
tgcactgagctactc

SEQ ID NO: 485599 - DNA, 15 bp, Homo sapiens
gcactgagctactcg

SEQ ID NO: 485600 - DNA, 15 bp, Homo sapiens
cactgagctactcgc

SEQ ID NO: 485601 - DNA, 15 bp, Homo sapiens
actgagctactcgct

SEQ ID NO: 485602 - DNA, 15 bp, Homo sapiens
ctgagctactcgctt

SEQ ID NO: 485603 - DNA, 15 bp, Homo sapiens
tgagctactcgcttg

SEQ ID NO: 485604 - DNA, 15 bp, Homo sapiens
gagctactcgcttga

SEQ ID NO: 485605 - DNA, 15 bp, Homo sapiens
agctactcgcttgat

SEQ ID NO: 485606 - DNA, 15 bp, Homo sapiens
gctactcgcttgatc

SEQ ID NO: 485607 - DNA, 15 bp, Homo sapiens
ctactcgcttgatcc

SEQ ID NO: 485608 - DNA, 15 bp, Homo sapiens
tactcgcttgatcca

SEQ ID NO: 485609 - DNA, 15 bp, Homo sapiens
actcgcttgatccag

SEQ ID NO: 485610 - DNA, 15 bp, Homo sapiens
ctcgcttgatccaga

SEQ ID NO: 485611 - DNA, 15 bp, Homo sapiens
tcgcttgatccagat

SEQ ID NO: 485612 - DNA, 15 bp, Homo sapiens
cgcttgatccagatg

SEQ ID NO: 485613 - DNA, 15 bp, Homo sapiens
gcttgatccagatgc

SEQ ID NO: 485614 - DNA, 15 bp, Homo sapiens
cttgatccagatgcc

SEQ ID NO: 485615 - DNA, 15 bp, Homo sapiens
ttgatccagatgcct

SEQ ID NO: 485616 - DNA, 15 bp, Homo sapiens
tgatccagatgcctc

SEQ ID NO: 485617 - DNA, 15 bp, Homo sapiens
gatccagatgcctcc

SEQ ID NO: 485618 - DNA, 15 bp, Homo sapiens
atccagatgcctccg

SEQ ID NO: 485619 - DNA, 15 bp, Homo sapiens
tccagatgcctccgg

SEQ ID NO: 485620 - DNA, 15 bp, Homo sapiens
ccagatgcctccggc

SEQ ID NO: 485621 - DNA, 15 bp, Homo sapiens
cagatgcctccggcc

SEQ ID NO: 485622 - DNA, 15 bp, Homo sapiens
agatgcctccggccc

SEQ ID NO: 485623 - DNA, 15 bp, Homo sapiens
gatgcctccggccca

SEQ ID NO: 485624 - DNA, 15 bp, Homo sapiens
atgcctccggcccac

SEQ ID NO: 485625 - DNA, 15 bp, Homo sapiens
tgcctccggcccaca

SEQ ID NO: 485626 - DNA, 15 bp, Homo sapiens
gcctccggcccacag

SEQ ID NO: 485627 - DNA, 15 bp, Homo sapiens
cctccggcccacagt

SEQ ID NO: 485628 - DNA, 15 bp, Homo sapiens
ctccggcccacagtt

SEQ ID NO: 485629 - DNA, 15 bp, Homo sapiens
tccggcccacagttc

SEQ ID NO: 485630 - DNA, 15 bp, Homo sapiens
ccggcccacagttcc

SEQ ID NO: 485631 - DNA, 15 bp, Homo sapiens
cggcccacagttcca

SEQ ID NO: 485632 - DNA, 15 bp, Homo sapiens
ggcccacagttccac

SEQ ID NO: 485633 - DNA, 15 bp, Homo sapiens
gcccacagttccacc

SEQ ID NO: 485634 - DNA, 15 bp, Homo sapiens
cccacagttccacca

SEQ ID NO: 485635 - DNA, 15 bp, Homo sapiens
ccacagttccaccag

SEQ ID NO: 485636 - DNA, 15 bp, Homo sapiens
cacagttccaccagg

SEQ ID NO: 485637 - DNA, 15 bp, Homo sapiens
acagttccaccaggc

SEQ ID NO: 485638 - DNA, 15 bp, Homo sapiens
cagttccaccaggca

SEQ ID NO: 485639 - DNA, 15 bp, Homo sapiens
agttccaccaggcag

SEQ ID NO: 485640 - DNA, 15 bp, Homo sapiens
gttccaccaggcagg

SEQ ID NO: 485641 - DNA, 15 bp, Homo sapiens
ttccaccaggcaggt

SEQ ID NO: 485642 - DNA, 15 bp, Homo sapiens
tccaccaggcaggtc

SEQ ID NO: 485643 - DNA, 15 bp, Homo sapiens
ccaccaggcaggtcg

SEQ ID NO: 485644 - DNA, 15 bp, Homo sapiens
caccaggcaggtcgg

SEQ ID NO: 485645 - DNA, 15 bp, Homo sapiens
accaggcaggtcggt

SEQ ID NO: 485646 - DNA, 15 bp, Homo sapiens
ccaggcaggtcggtg

SEQ ID NO: 485647 - DNA, 15 bp, Homo sapiens
caggcaggtcggtgt

SEQ ID NO: 485648 - DNA, 15 bp, Homo sapiens
aggcaggtcggtgtc

SEQ ID NO: 485649 - DNA, 15 bp, Homo sapiens
ggcaggtcggtgtcc

SEQ ID NO: 485650 - DNA, 15 bp, Homo sapiens
gcaggtcggtgtccc

SEQ ID NO: 485651 - DNA, 15 bp, Homo sapiens
caggtcggtgtcccc

SEQ ID NO: 485652 - DNA, 15 bp, Homo sapiens
aggtcggtgtcccca

SEQ ID NO: 485653 - DNA, 15 bp, Homo sapiens
ggtcggtgtccccag

SEQ ID NO: 485654 - DNA, 15 bp, Homo sapiens
gtcggtgtccccagc

SEQ ID NO: 485655 - DNA, 15 bp, Homo sapiens
tcggtgtccccagca

SEQ ID NO: 485656 - DNA, 15 bp, Homo sapiens
cggtgtccccagcac

SEQ ID NO: 485657 - DNA, 15 bp, Homo sapiens
ggtgtccccagcaca

SEQ ID NO: 485658 - DNA, 15 bp, Homo sapiens
gtgtccccagcacac

SEQ ID NO: 485659 - DNA, 15 bp, Homo sapiens
tgtccccagcacaca

SEQ ID NO: 485660 - DNA, 15 bp, Homo sapiens
gtccccagcacacag

SEQ ID NO: 485661 - DNA, 15 bp, Homo sapiens
tccccagcacacagc

SEQ ID NO: 485662 - DNA, 15 bp, Homo sapiens
ccccagcacacagct

SEQ ID NO: 485663 - DNA, 15 bp, Homo sapiens
cccagcacacagctc

SEQ ID NO: 485664 - DNA, 15 bp, Homo sapiens
ccagcacacagctcc

SEQ ID NO: 485665 - DNA, 15 bp, Homo sapiens
cagcacacagctcct

SEQ ID NO: 485666 - DNA, 15 bp, Homo sapiens
agcacacagctcctc

SEQ ID NO: 485667 - DNA, 15 bp, Homo sapiens
gcacacagctcctct

SEQ ID NO: 485668 - DNA, 15 bp, Homo sapiens
cacacagctcctctg

SEQ ID NO: 485669 - DNA, 15 bp, Homo sapiens
acacagctcctctgc

SEQ ID NO: 485670 - DNA, 15 bp, Homo sapiens
cacagctcctctgct

SEQ ID NO: 485671 - DNA, 15 bp, Homo sapiens
acagctcctctgctg

SEQ ID NO: 485672 - DNA, 15 bp, Homo sapiens
cagctcctctgctga

SEQ ID NO: 485673 - DNA, 15 bp, Homo sapiens
agctcctctgctgag

SEQ ID NO: 485674 - DNA, 15 bp, Homo sapiens
gctcctctgctgagt

SEQ ID NO: 485675 - DNA, 15 bp, Homo sapiens
ctcctctgctgagtc

SEQ ID NO: 485676 - DNA, 15 bp, Homo sapiens
tcctctgctgagtct

SEQ ID NO: 485677 - DNA, 15 bp, Homo sapiens
cctctgctgagtctg

SEQ ID NO: 485678 - DNA, 15 bp, Homo sapiens
ctctgctgagtctgc

SEQ ID NO: 485679 - DNA, 15 bp, Homo sapiens
tctgctgagtctgct

SEQ ID NO: 485680 - DNA, 15 bp, Homo sapiens
ctgctgagtctgctt

SEQ ID NO: 485681 - DNA, 15 bp, Homo sapiens
tgctgagtctgcttt

SEQ ID NO: 485682 - DNA, 15 bp, Homo sapiens
gctgagtctgctttg

SEQ ID NO: 485683 - DNA, 15 bp, Homo sapiens
ctgagtctgctttgt

SEQ ID NO: 485684 - DNA, 15 bp, Homo sapiens
tgagtctgctttgtg

SEQ ID NO: 485685 - DNA, 15 bp, Homo sapiens
gagtctgctttgtgc

SEQ ID NO: 485686 - DNA, 15 bp, Homo sapiens
agtctgctttgtgct

SEQ ID NO: 485687 - DNA, 15 bp, Homo sapiens
gtctgctttgtgctt

SEQ ID NO: 485688 - DNA, 15 bp, Homo sapiens
tctgctttgtgcttt

SEQ ID NO: 485689 - DNA, 15 bp, Homo sapiens
ctgctttgtgctttg

SEQ ID NO: 485690 - DNA, 15 bp, Homo sapiens
tgctttgtgctttgc

SEQ ID NO: 485691 - DNA, 15 bp, Homo sapiens
gctttgtgctttgcc

SEQ ID NO: 485692 - DNA, 15 bp, Homo sapiens
ctttgtgctttgcca

SEQ ID NO: 485693 - DNA, 15 bp, Homo sapiens
tttgtgctttgccat

SEQ ID NO: 485694 - DNA, 15 bp, Homo sapiens
ttgtgctttgccatt

SEQ ID NO: 485695 - DNA, 15 bp, Homo sapiens
tgtgctttgccatta

SEQ ID NO: 485696 - DNA, 15 bp, Homo sapiens
gtgctttgccattag

SEQ ID NO: 485697 - DNA, 15 bp, Homo sapiens
tgctttgccattagt

SEQ ID NO: 485698 - DNA, 15 bp, Homo sapiens
gctttgccattagtt

SEQ ID NO: 485699 - DNA, 15 bp, Homo sapiens
ctttgccattagttt

SEQ ID NO: 485700 - DNA, 15 bp, Homo sapiens
tttgccattagtttg

SEQ ID NO: 485701 - DNA, 15 bp, Homo sapiens
ttgccattagtttgt

SEQ ID NO: 485702 - DNA, 15 bp, Homo sapiens
tgccattagtttgtg

SEQ ID NO: 485703 - DNA, 15 bp, Homo sapiens
gccattagtttgtgt

SEQ ID NO: 485704 - DNA, 15 bp, Homo sapiens
ccattagtttgtgtt

SEQ ID NO: 485705 - DNA, 15 bp, Homo sapiens
cattagtttgtgttt

SEQ ID NO: 485706 - DNA, 15 bp, Homo sapiens
attagtttgtgtttc

SEQ ID NO: 485707 - DNA, 15 bp, Homo sapiens
ttagtttgtgtttcc

SEQ ID NO: 485708 - DNA, 15 bp, Homo sapiens
tagtttgtgtttcct

SEQ ID NO: 485709 - DNA, 15 bp, Homo sapiens
agtttgtgtttcctg

SEQ ID NO: 485710 - DNA, 15 bp, Homo sapiens
gtttgtgtttcctgt

SEQ ID NO: 485711 - DNA, 15 bp, Homo sapiens
tttgtgtttcctgtt

SEQ ID NO: 485712 - DNA, 15 bp, Homo sapiens
ttgtgtttcctgtta

SEQ ID NO: 485713 - DNA, 15 bp, Homo sapiens
tgtgtttcctgttaa

SEQ ID NO: 485714 - DNA, 15 bp, Homo sapiens
gtgtttcctgttaag

SEQ ID NO: 485715 - DNA, 15 bp, Homo sapiens
tgtttcctgttaagt

SEQ ID NO: 485716 - DNA, 15 bp, Homo sapiens
gtttcctgttaagta

SEQ ID NO: 485717 - DNA, 15 bp, Homo sapiens
tttcctgttaagtaa

SEQ ID NO: 485718 - DNA, 15 bp, Homo sapiens
ttcctgttaagtaac

SEQ ID NO: 485719 - DNA, 15 bp, Homo sapiens
tcctgttaagtaaca

SEQ ID NO: 485720 - DNA, 15 bp, Homo sapiens
cctgttaagtaacat

SEQ ID NO: 485721 - DNA, 15 bp, Homo sapiens
ctgttaagtaacatt

SEQ ID NO: 485722 - DNA, 15 bp, Homo sapiens
tgttaagtaacattc

SEQ ID NO: 485723 - DNA, 15 bp, Homo sapiens
gttaagtaacattcc

SEQ ID NO: 485724 - DNA, 15 bp, Homo sapiens
ttaagtaacattcct

SEQ ID NO: 485725 - DNA, 15 bp, Homo sapiens
taagtaacattccta

SEQ ID NO: 485726 - DNA, 15 bp, Homo sapiens
aagtaacattcctac

SEQ ID NO: 485727 - DNA, 15 bp, Homo sapiens
agtaacattcctaca

SEQ ID NO: 485728 - DNA, 15 bp, Homo sapiens
gtaacattcctacac

SEQ ID NO: 485729 - DNA, 15 bp, Homo sapiens
taacattcctacaca

SEQ ID NO: 485730 - DNA, 15 bp, Homo sapiens
aacattcctacacac

SEQ ID NO: 485731 - DNA, 15 bp, Homo sapiens
acattcctacacact

SEQ ID NO: 485732 - DNA, 15 bp, Homo sapiens
cattcctacacactg

SEQ ID NO: 485733 - DNA, 15 bp, Homo sapiens
attcctacacactgg

SEQ ID NO: 485734 - DNA, 15 bp, Homo sapiens
ttcctacacactggt

SEQ ID NO: 485735 - DNA, 15 bp, Homo sapiens
tcctacacactggtg

SEQ ID NO: 485736 - DNA, 15 bp, Homo sapiens
cctacacactggtgc

SEQ ID NO: 485737 - DNA, 15 bp, Homo sapiens
ctacacactggtgcc

SEQ ID NO: 485738 - DNA, 15 bp, Homo sapiens
tacacactggtgcct

SEQ ID NO: 485739 - DNA, 15 bp, Homo sapiens
acacactggtgcctt

SEQ ID NO: 485740 - DNA, 15 bp, Homo sapiens
cacactggtgcctta

SEQ ID NO: 485741 - DNA, 15 bp, Homo sapiens
acactggtgccttag

SEQ ID NO: 485742 - DNA, 15 bp, Homo sapiens
cactggtgccttagg

SEQ ID NO: 485743 - DNA, 15 bp, Homo sapiens
actggtgccttagga

SEQ ID NO: 485744 - DNA, 15 bp, Homo sapiens
ctggtgccttaggaa

SEQ ID NO: 485745 - DNA, 15 bp, Homo sapiens
tggtgccttaggaag

SEQ ID NO: 485746 - DNA, 15 bp, Homo sapiens
ggtgccttaggaagt

SEQ ID NO: 485747 - DNA, 15 bp, Homo sapiens
gtgccttaggaagta

SEQ ID NO: 485748 - DNA, 15 bp, Homo sapiens
tgccttaggaagtaa

SEQ ID NO: 485749 - DNA, 15 bp, Homo sapiens
gccttaggaagtaaa

SEQ ID NO: 485750 - DNA, 15 bp, Homo sapiens
ccttaggaagtaaaa

SEQ ID NO: 485751 - DNA, 15 bp, Homo sapiens
cttaggaagtaaaag

SEQ ID NO: 485752 - DNA, 15 bp, Homo sapiens
ttaggaagtaaaaga

SEQ ID NO: 485753 - DNA, 15 bp, Homo sapiens
taggaagtaaaagag

SEQ ID NO: 485754 - DNA, 15 bp, Homo sapiens
aggaagtaaaagagt

SEQ ID NO: 485755 - DNA, 15 bp, Homo sapiens
ggaagtaaaagagtt

SEQ ID NO: 485756 - DNA, 15 bp, Homo sapiens
gaagtaaaagagttt

SEQ ID NO: 485757 - DNA, 15 bp, Homo sapiens
aagtaaaagagtttt

SEQ ID NO: 485758 - DNA, 15 bp, Homo sapiens
agtaaaagagttttt

SEQ ID NO: 485759 - DNA, 15 bp, Homo sapiens
gtaaaagagtttttt

SEQ ID NO: 485760 - DNA, 15 bp, Homo sapiens
taaaagagttttttg

SEQ ID NO: 485761 - DNA, 15 bp, Homo sapiens
aaaagagttttttgt

SEQ ID NO: 485762 - DNA, 15 bp, Homo sapiens
aaagagttttttgta

SEQ ID NO: 485763 - DNA, 15 bp, Homo sapiens
aagagttttttgtat

SEQ ID NO: 485764 - DNA, 15 bp, Homo sapiens
agagttttttgtatt

SEQ ID NO: 485765 - DNA, 15 bp, Homo sapiens
gagttttttgtattt

SEQ ID NO: 485766 - DNA, 15 bp, Homo sapiens
agttttttgtatttg

SEQ ID NO: 485767 - DNA, 15 bp, Homo sapiens
gttttttgtatttgg

SEQ ID NO: 485768 - DNA, 15 bp, Homo sapiens
ttttttgtatttggt

SEQ ID NO: 485769 - DNA, 15 bp, Homo sapiens
tttttgtatttggtc

SEQ ID NO: 485770 - DNA, 15 bp, Homo sapiens
ttttgtatttggtct

SEQ ID NO: 485771 - DNA, 15 bp, Homo sapiens
tttgtatttggtctt

SEQ ID NO: 485772 - DNA, 15 bp, Homo sapiens
ttgtatttggtctta

SEQ ID NO: 485773 - DNA, 15 bp, Homo sapiens
tgtatttggtcttaa

SEQ ID NO: 485774 - DNA, 15 bp, Homo sapiens
gtatttggtcttaaa

SEQ ID NO: 485775 - DNA, 15 bp, Homo sapiens
tatttggtcttaaat

SEQ ID NO: 485776 - DNA, 15 bp, Homo sapiens
atttggtcttaaata

SEQ ID NO: 485777 - DNA, 15 bp, Homo sapiens
tttggtcttaaatag

SEQ ID NO: 485778 - DNA, 15 bp, Homo sapiens
ttggtcttaaatagg

SEQ ID NO: 485779 - DNA, 15 bp, Homo sapiens
tggtcttaaataggt

SEQ ID NO: 485780 - DNA, 15 bp, Homo sapiens
ggtcttaaataggtg

SEQ ID NO: 485781 - DNA, 15 bp, Homo sapiens
gtcttaaataggtgc

SEQ ID NO: 485782 - DNA, 15 bp, Homo sapiens
tcttaaataggtgca

SEQ ID NO: 485783 - DNA, 15 bp, Homo sapiens
cttaaataggtgcaa

SEQ ID NO: 485784 - DNA, 15 bp, Homo sapiens
ttaaataggtgcaaa

SEQ ID NO: 485785 - DNA, 15 bp, Homo sapiens
taaataggtgcaaat

SEQ ID NO: 485786 - DNA, 15 bp, Homo sapiens
aaataggtgcaaatc

SEQ ID NO: 485787 - DNA, 15 bp, Homo sapiens
aataggtgcaaatcc

SEQ ID NO: 485788 - DNA, 15 bp, Homo sapiens
ataggtgcaaatcca

SEQ ID NO: 485789 - DNA, 15 bp, Homo sapiens
taggtgcaaatccat

SEQ ID NO: 485790 - DNA, 15 bp, Homo sapiens
aggtgcaaatccatt

SEQ ID NO: 485791 - DNA, 15 bp, Homo sapiens
ggtgcaaatccattt

SEQ ID NO: 485792 - DNA, 15 bp, Homo sapiens
gtgcaaatccatttc

SEQ ID NO: 485793 - DNA, 15 bp, Homo sapiens
tgcaaatccatttca

SEQ ID NO: 485794 - DNA, 15 bp, Homo sapiens
gcaaatccatttcaa

SEQ ID NO: 485795 - DNA, 15 bp, Homo sapiens
caaatccatttcaac

SEQ ID NO: 485796 - DNA, 15 bp, Homo sapiens
aaatccatttcaaca

SEQ ID NO: 485797 - DNA, 15 bp, Homo sapiens
aatccatttcaacaa

SEQ ID NO: 485798 - DNA, 15 bp, Homo sapiens
atccatttcaacaat

SEQ ID NO: 485799 - DNA, 15 bp, Homo sapiens
tccatttcaacaata

SEQ ID NO: 485800 - DNA, 15 bp, Homo sapiens
ccatttcaacaatat

SEQ ID NO: 485801 - DNA, 15 bp, Homo sapiens
catttcaacaatatc

SEQ ID NO: 485802 - DNA, 15 bp, Homo sapiens
atttcaacaatatca

SEQ ID NO: 485803 - DNA, 15 bp, Homo sapiens
tttcaacaatatcaa

SEQ ID NO: 485804 - DNA, 15 bp, Homo sapiens
ttcaacaatatcaaa

SEQ ID NO: 485805 - DNA, 15 bp, Homo sapiens
tcaacaatatcaaaa

SEQ ID NO: 485806 - DNA, 15 bp, Homo sapiens
caacaatatcaaaaa

SEQ ID NO: 485807 - DNA, 15 bp, Homo sapiens
aacaatatcaaaaag

SEQ ID NO: 485808 - DNA, 15 bp, Homo sapiens
acaatatcaaaaagc

SEQ ID NO: 485809 - DNA, 15 bp, Homo sapiens
caatatcaaaaagca

SEQ ID NO: 485810 - DNA, 15 bp, Homo sapiens
aatatcaaaaagcaa

SEQ ID NO: 485811 - DNA, 15 bp, Homo sapiens
atatcaaaaagcaaa

SEQ ID NO: 485812 - DNA, 15 bp, Homo sapiens
tatcaaaaagcaaac

SEQ ID NO: 485813 - DNA, 15 bp, Homo sapiens
atcaaaaagcaaaca

SEQ ID NO: 485814 - DNA, 15 bp, Homo sapiens
tcaaaaagcaaacat

SEQ ID NO: 485815 - DNA, 15 bp, Homo sapiens
caaaaagcaaacatt

SEQ ID NO: 485816 - DNA, 15 bp, Homo sapiens
aaaaagcaaacattt

SEQ ID NO: 485817 - DNA, 15 bp, Homo sapiens
aaaagcaaacatttt

SEQ ID NO: 485818 - DNA, 15 bp, Homo sapiens
aaagcaaacattttc

SEQ ID NO: 485819 - DNA, 15 bp, Homo sapiens
aagcaaacattttca

SEQ ID NO: 485820 - DNA, 15 bp, Homo sapiens
agcaaacattttcaa

SEQ ID NO: 485821 - DNA, 15 bp, Homo sapiens
gcaaacattttcaaa

SEQ ID NO: 485822 - DNA, 15 bp, Homo sapiens
caaacattttcaaat

SEQ ID NO: 485823 - DNA, 15 bp, Homo sapiens
aaacattttcaaata

SEQ ID NO: 485824 - DNA, 15 bp, Homo sapiens
aacattttcaaataa

SEQ ID NO: 485825 - DNA, 15 bp, Homo sapiens
acattttcaaataag

SEQ ID NO: 485826 - DNA, 15 bp, Homo sapiens
cattttcaaataagc

SEQ ID NO: 485827 - DNA, 15 bp, Homo sapiens
attttcaaataagct

SEQ ID NO: 485828 - DNA, 15 bp, Homo sapiens
ttttcaaataagcta

SEQ ID NO: 485829 - DNA, 15 bp, Homo sapiens
tttcaaataagctat

SEQ ID NO: 485830 - DNA, 15 bp, Homo sapiens
ttcaaataagctata

SEQ ID NO: 485831 - DNA, 15 bp, Homo sapiens
tcaaataagctataa

SEQ ID NO: 485832 - DNA, 15 bp, Homo sapiens
caaataagctataat

SEQ ID NO: 485833 - DNA, 15 bp, Homo sapiens
aaataagctataata

SEQ ID NO: 485834 - DNA, 15 bp, Homo sapiens
aataagctataatac

SEQ ID NO: 485835 - DNA, 15 bp, Homo sapiens
ataagctataataca

SEQ ID NO: 485836 - DNA, 15 bp, Homo sapiens
taagctataatacac

SEQ ID NO: 485837 - DNA, 15 bp, Homo sapiens
aagctataatacact

SEQ ID NO: 485838 - DNA, 15 bp, Homo sapiens
agctataatacactt

SEQ ID NO: 485839 - DNA, 15 bp, Homo sapiens
gctataatacacttg

SEQ ID NO: 485840 - DNA, 15 bp, Homo sapiens
ctataatacacttgt

SEQ ID NO: 485841 - DNA, 15 bp, Homo sapiens
tataatacacttgtt

SEQ ID NO: 485842 - DNA, 15 bp, Homo sapiens
ataatacacttgttt

SEQ ID NO: 485843 - DNA, 15 bp, Homo sapiens
taatacacttgttta

SEQ ID NO: 485844 - DNA, 15 bp, Homo sapiens
aatacacttgtttat

SEQ ID NO: 485845 - DNA, 15 bp, Homo sapiens
atacacttgtttata

SEQ ID NO: 485846 - DNA, 15 bp, Homo sapiens
tacacttgtttatat

SEQ ID NO: 485847 - DNA, 15 bp, Homo sapiens
acacttgtttatata

SEQ ID NO: 485848 - DNA, 15 bp, Homo sapiens
cacttgtttatataa

SEQ ID NO: 485849 - DNA, 15 bp, Homo sapiens
acttgtttatataat

SEQ ID NO: 485850 - DNA, 15 bp, Homo sapiens
cttgtttatataatc

SEQ ID NO: 485851 - DNA, 15 bp, Homo sapiens
ttgtttatataatct

SEQ ID NO: 485852 - DNA, 15 bp, Homo sapiens
tgtttatataatctg

SEQ ID NO: 485853 - DNA, 15 bp, Homo sapiens
gtttatataatctgt

SEQ ID NO: 485854 - DNA, 15 bp, Homo sapiens
tttatataatctgta

SEQ ID NO: 485855 - DNA, 15 bp, Homo sapiens
ttatataatctgtag

SEQ ID NO: 485856 - DNA, 15 bp, Homo sapiens
tatataatctgtaga

SEQ ID NO: 485857 - DNA, 15 bp, Homo sapiens
atataatctgtagaa

SEQ ID NO: 485858 - DNA, 15 bp, Homo sapiens
tataatctgtagaag

SEQ ID NO: 485859 - DNA, 15 bp, Homo sapiens
ataatctgtagaagt

SEQ ID NO: 485860 - DNA, 15 bp, Homo sapiens
taatctgtagaagtg

SEQ ID NO: 485861 - DNA, 15 bp, Homo sapiens
aatctgtagaagtgg

SEQ ID NO: 485862 - DNA, 15 bp, Homo sapiens
atctgtagaagtgga

SEQ ID NO: 485863 - DNA, 15 bp, Homo sapiens
tctgtagaagtggat

SEQ ID NO: 485864 - DNA, 15 bp, Homo sapiens
ctgtagaagtggatt

SEQ ID NO: 485865 - DNA, 15 bp, Homo sapiens
tgtagaagtggattg

SEQ ID NO: 485866 - DNA, 15 bp, Homo sapiens
gtagaagtggattga

SEQ ID NO: 485867 - DNA, 15 bp, Homo sapiens
tagaagtggattgaa

SEQ ID NO: 485868 - DNA, 15 bp, Homo sapiens
agaagtggattgaag

SEQ ID NO: 485869 - DNA, 15 bp, Homo sapiens
gaagtggattgaagt

SEQ ID NO: 485870 - DNA, 15 bp, Homo sapiens
aagtggattgaagtt

SEQ ID NO: 485871 - DNA, 15 bp, Homo sapiens
agtggattgaagttt

SEQ ID NO: 485872 - DNA, 15 bp, Homo sapiens
gtggattgaagtttg

SEQ ID NO: 485873 - DNA, 15 bp, Homo sapiens
tggattgaagtttgg

SEQ ID NO: 485874 - DNA, 15 bp, Homo sapiens
ggattgaagtttgga

SEQ ID NO: 485875 - DNA, 15 bp, Homo sapiens
gattgaagtttggat

SEQ ID NO: 485876 - DNA, 15 bp, Homo sapiens
attgaagtttggatg

SEQ ID NO: 485877 - DNA, 15 bp, Homo sapiens
ttgaagtttggatga

SEQ ID NO: 485878 - DNA, 15 bp, Homo sapiens
tgaagtttggatgaa

SEQ ID NO: 485879 - DNA, 15 bp, Homo sapiens
gaagtttggatgaaa

SEQ ID NO: 485880 - DNA, 15 bp, Homo sapiens
aagtttggatgaaaa

SEQ ID NO: 485881 - DNA, 15 bp, Homo sapiens
agtttggatgaaaaa

SEQ ID NO: 485882 - DNA, 15 bp, Homo sapiens
gtttggatgaaaaag

SEQ ID NO: 485883 - DNA, 15 bp, Homo sapiens
tttggatgaaaaagc

SEQ ID NO: 485884 - DNA, 15 bp, Homo sapiens
ttggatgaaaaagcc

SEQ ID NO: 485885 - DNA, 15 bp, Homo sapiens
tggatgaaaaagcct

SEQ ID NO: 485886 - DNA, 15 bp, Homo sapiens
ggatgaaaaagcctc

SEQ ID NO: 485887 - DNA, 15 bp, Homo sapiens
gatgaaaaagcctcc

SEQ ID NO: 485888 - DNA, 15 bp, Homo sapiens
atgaaaaagcctcct

SEQ ID NO: 485889 - DNA, 15 bp, Homo sapiens
tgaaaaagcctcctc

SEQ ID NO: 485890 - DNA, 15 bp, Homo sapiens
gaaaaagcctcctct

SEQ ID NO: 485891 - DNA, 15 bp, Homo sapiens
aaaaagcctcctctg

SEQ ID NO: 485892 - DNA, 15 bp, Homo sapiens
aaaagcctcctctgc

SEQ ID NO: 485893 - DNA, 15 bp, Homo sapiens
aaagcctcctctgcc

SEQ ID NO: 485894 - DNA, 15 bp, Homo sapiens
aagcctcctctgccc

SEQ ID NO: 485895 - DNA, 15 bp, Homo sapiens
agcctcctctgccct

SEQ ID NO: 485896 - DNA, 15 bp, Homo sapiens
gcctcctctgccctt

SEQ ID NO: 485897 - DNA, 15 bp, Homo sapiens
cctcctctgcccttt

SEQ ID NO: 485898 - DNA, 15 bp, Homo sapiens
ctcctctgcccttta

SEQ ID NO: 485899 - DNA, 15 bp, Homo sapiens
tcctctgccctttag

SEQ ID NO: 485900 - DNA, 15 bp, Homo sapiens
cctctgccctttaga

SEQ ID NO: 485901 - DNA, 15 bp, Homo sapiens
ctctgccctttagaa

SEQ ID NO: 485902 - DNA, 15 bp, Homo sapiens
tctgccctttagaat

SEQ ID NO: 485903 - DNA, 15 bp, Homo sapiens
ctgccctttagaatg

SEQ ID NO: 485904 - DNA, 15 bp, Homo sapiens
tgccctttagaatga

SEQ ID NO: 485905 - DNA, 15 bp, Homo sapiens
gccctttagaatgag

SEQ ID NO: 485906 - DNA, 15 bp, Homo sapiens
ccctttagaatgagc

SEQ ID NO: 485907 - DNA, 15 bp, Homo sapiens
cctttagaatgagca

SEQ ID NO: 485908 - DNA, 15 bp, Homo sapiens
ctttagaatgagcaa

SEQ ID NO: 485909 - DNA, 15 bp, Homo sapiens
tttagaatgagcaag

SEQ ID NO: 485910 - DNA, 15 bp, Homo sapiens
ttagaatgagcaaga

SEQ ID NO: 485911 - DNA, 15 bp, Homo sapiens
tagaatgagcaagaa

SEQ ID NO: 485912 - DNA, 15 bp, Homo sapiens
agaatgagcaagaaa

SEQ ID NO: 485913 - DNA, 15 bp, Homo sapiens
gaatgagcaagaaat

SEQ ID NO: 485914 - DNA, 15 bp, Homo sapiens
aatgagcaagaaatt

SEQ ID NO: 485915 - DNA, 15 bp, Homo sapiens
atgagcaagaaatta

SEQ ID NO: 485916 - DNA, 15 bp, Homo sapiens
tgagcaagaaattaa

SEQ ID NO: 485917 - DNA, 15 bp, Homo sapiens
gagcaagaaattaaa

SEQ ID NO: 485918 - DNA, 15 bp, Homo sapiens
agcaagaaattaaat

SEQ ID NO: 485919 - DNA, 15 bp, Homo sapiens
gcaagaaattaaatt

SEQ ID NO: 485920 - DNA, 15 bp, Homo sapiens
caagaaattaaatta

SEQ ID NO: 485921 - DNA, 15 bp, Homo sapiens
aagaaattaaattat

SEQ ID NO: 485922 - DNA, 15 bp, Homo sapiens
agaaattaaattatt

SEQ ID NO: 485923 - DNA, 15 bp, Homo sapiens
gaaattaaattattt

SEQ ID NO: 485924 - DNA, 15 bp, Homo sapiens
aaattaaattatttg

SEQ ID NO: 485925 - DNA, 15 bp, Homo sapiens
aattaaattatttgc

SEQ ID NO: 485926 - DNA, 15 bp, Homo sapiens
attaaattatttgct

SEQ ID NO: 485927 - DNA, 15 bp, Homo sapiens
ttaaattatttgctt

SEQ ID NO: 485928 - DNA, 15 bp, Homo sapiens
taaattatttgctta

SEQ ID NO: 485929 - DNA, 15 bp, Homo sapiens
aaattatttgcttat

SEQ ID NO: 485930 - DNA, 15 bp, Homo sapiens
aattatttgcttatg

SEQ ID NO: 485931 - DNA, 15 bp, Homo sapiens
attatttgcttatga

SEQ ID NO: 485932 - DNA, 15 bp, Homo sapiens
ttatttgcttatgaa

SEQ ID NO: 485933 - DNA, 15 bp, Homo sapiens
tatttgcttatgaat

SEQ ID NO: 485934 - DNA, 15 bp, Homo sapiens
atttgcttatgaatg

SEQ ID NO: 485935 - DNA, 15 bp, Homo sapiens
tttgcttatgaatga

SEQ ID NO: 485936 - DNA, 15 bp, Homo sapiens
ttgcttatgaatgat

SEQ ID NO: 485937 - DNA, 15 bp, Homo sapiens
tgcttatgaatgatt

SEQ ID NO: 485938 - DNA, 15 bp, Homo sapiens
gcttatgaatgattt

SEQ ID NO: 485939 - DNA, 15 bp, Homo sapiens
cttatgaatgatttt

SEQ ID NO: 485940 - DNA, 15 bp, Homo sapiens
ttatgaatgattttt

SEQ ID NO: 485941 - DNA, 15 bp, Homo sapiens
tatgaatgatttttt

SEQ ID NO: 485942 - DNA, 15 bp, Homo sapiens
atgaatgattttttt

SEQ ID NO: 485943 - DNA, 15 bp, Homo sapiens
tgaatgattttttta

SEQ ID NO: 485944 - DNA, 15 bp, Homo sapiens
gaatgatttttttag

SEQ ID NO: 485945 - DNA, 15 bp, Homo sapiens
aatgatttttttagt

SEQ ID NO: 485946 - DNA, 15 bp, Homo sapiens
atgatttttttagta

SEQ ID NO: 485947 - DNA, 15 bp, Homo sapiens
tgatttttttagtac

SEQ ID NO: 485948 - DNA, 15 bp, Homo sapiens
gatttttttagtaca

SEQ ID NO: 485949 - DNA, 15 bp, Homo sapiens
atttttttagtacac

SEQ ID NO: 485950 - DNA, 15 bp, Homo sapiens
tttttttagtacact

SEQ ID NO: 485951 - DNA, 15 bp, Homo sapiens
ttttttagtacactt

SEQ ID NO: 485952 - DNA, 15 bp, Homo sapiens
tttttagtacacttt

SEQ ID NO: 485953 - DNA, 15 bp, Homo sapiens
ttttagtacactttc

SEQ ID NO: 485954 - DNA, 15 bp, Homo sapiens
tttagtacactttct

SEQ ID NO: 485955 - DNA, 15 bp, Homo sapiens
ttagtacactttctg

SEQ ID NO: 485956 - DNA, 15 bp, Homo sapiens
tagtacactttctgt

SEQ ID NO: 485957 - DNA, 15 bp, Homo sapiens
agtacactttctgtc

SEQ ID NO: 485958 - DNA, 15 bp, Homo sapiens
gtacactttctgtct

SEQ ID NO: 485959 - DNA, 15 bp, Homo sapiens
tacactttctgtctc

SEQ ID NO: 485960 - DNA, 15 bp, Homo sapiens
acactttctgtctct

SEQ ID NO: 485961 - DNA, 15 bp, Homo sapiens
cactttctgtctcta

SEQ ID NO: 485962 - DNA, 15 bp, Homo sapiens
actttctgtctctaa

SEQ ID NO: 485963 - DNA, 15 bp, Homo sapiens
ctttctgtctctaaa

SEQ ID NO: 485964 - DNA, 15 bp, Homo sapiens
tttctgtctctaaaa

SEQ ID NO: 485965 - DNA, 15 bp, Homo sapiens
ttctgtctctaaaat

SEQ ID NO: 485966 - DNA, 15 bp, Homo sapiens
tctgtctctaaaatg

SEQ ID NO: 485967 - DNA, 15 bp, Homo sapiens
ctgtctctaaaatgt

SEQ ID NO: 485968 - DNA, 15 bp, Homo sapiens
tgtctctaaaatgtt

SEQ ID NO: 485969 - DNA, 15 bp, Homo sapiens
gtctctaaaatgtta

SEQ ID NO: 485970 - DNA, 15 bp, Homo sapiens
tctctaaaatgttac

SEQ ID NO: 485971 - DNA, 15 bp, Homo sapiens
ctctaaaatgttaca

SEQ ID NO: 485972 - DNA, 15 bp, Homo sapiens
tctaaaatgttacat

SEQ ID NO: 485973 - DNA, 15 bp, Homo sapiens
ctaaaatgttacatt

SEQ ID NO: 485974 - DNA, 15 bp, Homo sapiens
taaaatgttacattg

SEQ ID NO: 485975 - DNA, 15 bp, Homo sapiens
aaaatgttacattgg

SEQ ID NO: 485976 - DNA, 15 bp, Homo sapiens
aaatgttacattggt

SEQ ID NO: 485977 - DNA, 15 bp, Homo sapiens
aatgttacattggtg

SEQ ID NO: 485978 - DNA, 15 bp, Homo sapiens
atgttacattggtgc

SEQ ID NO: 485979 - DNA, 15 bp, Homo sapiens
tgttacattggtgca

SEQ ID NO: 485980 - DNA, 15 bp, Homo sapiens
gttacattggtgcat

SEQ ID NO: 485981 - DNA, 15 bp, Homo sapiens
ttacattggtgcata

SEQ ID NO: 485982 - DNA, 15 bp, Homo sapiens
tacattggtgcatat

SEQ ID NO: 485983 - DNA, 15 bp, Homo sapiens
acattggtgcatatt

SEQ ID NO: 485984 - DNA, 15 bp, Homo sapiens
cattggtgcatattc

SEQ ID NO: 485985 - DNA, 15 bp, Homo sapiens
attggtgcatattca

SEQ ID NO: 485986 - DNA, 15 bp, Homo sapiens
ttggtgcatattcag

SEQ ID NO: 485987 - DNA, 15 bp, Homo sapiens
tggtgcatattcagg

SEQ ID NO: 485988 - DNA, 15 bp, Homo sapiens
ggtgcatattcagga

SEQ ID NO: 485989 - DNA, 15 bp, Homo sapiens
gtgcatattcaggac

SEQ ID NO: 485990 - DNA, 15 bp, Homo sapiens
tgcatattcaggact

SEQ ID NO: 485991 - DNA, 15 bp, Homo sapiens
gcatattcaggacta

SEQ ID NO: 485992 - DNA, 15 bp, Homo sapiens
catattcaggactaa

SEQ ID NO: 485993 - DNA, 15 bp, Homo sapiens
atattcaggactaat

SEQ ID NO: 485994 - DNA, 15 bp, Homo sapiens
tattcaggactaata

SEQ ID NO: 485995 - DNA, 15 bp, Homo sapiens
attcaggactaataa

SEQ ID NO: 485996 - DNA, 15 bp, Homo sapiens
ttcaggactaataat

SEQ ID NO: 485997 - DNA, 15 bp, Homo sapiens
tcaggactaataata

SEQ ID NO: 485998 - DNA, 15 bp, Homo sapiens
caggactaataatat

SEQ ID NO: 485999 - DNA, 15 bp, Homo sapiens
aggactaataatatt

SEQ ID NO: 486000 - DNA, 15 bp, Homo sapiens
ggactaataatatta

SEQ ID NO: 486001 - DNA, 15 bp, Homo sapiens
gactaataatattac

SEQ ID NO: 486002 - DNA, 15 bp, Homo sapiens
actaataatattaca

SEQ ID NO: 486003 - DNA, 15 bp, Homo sapiens
ctaataatattacac

SEQ ID NO: 486004 - DNA, 15 bp, Homo sapiens
taataatattacacc

SEQ ID NO: 486005 - DNA, 15 bp, Homo sapiens
aataatattacacca

SEQ ID NO: 486006 - DNA, 15 bp, Homo sapiens
ataatattacaccaa

SEQ ID NO: 486007 - DNA, 15 bp, Homo sapiens
taatattacaccaaa

SEQ ID NO: 486008 - DNA, 15 bp, Homo sapiens
aatattacaccaaac

SEQ ID NO: 486009 - DNA, 15 bp, Homo sapiens
atattacaccaaaca

SEQ ID NO: 486010 - DNA, 15 bp, Homo sapiens
tattacaccaaacat

SEQ ID NO: 486011 - DNA, 15 bp, Homo sapiens
attacaccaaacatt

SEQ ID NO: 486012 - DNA, 15 bp, Homo sapiens
ttacaccaaacatta

SEQ ID NO: 486013 - DNA, 15 bp, Homo sapiens
tacaccaaacattat

SEQ ID NO: 486014 - DNA, 15 bp, Homo sapiens
acaccaaacattatg

SEQ ID NO: 486015 - DNA, 15 bp, Homo sapiens
caccaaacattatgg

SEQ ID NO: 486016 - DNA, 15 bp, Homo sapiens
accaaacattatggt

SEQ ID NO: 486017 - DNA, 15 bp, Homo sapiens
ccaaacattatggtt

SEQ ID NO: 486018 - DNA, 15 bp, Homo sapiens
caaacattatggttg

SEQ ID NO: 486019 - DNA, 15 bp, Homo sapiens
aaacattatggttgt

SEQ ID NO: 486020 - DNA, 15 bp, Homo sapiens
aacattatggttgta

SEQ ID NO: 486021 - DNA, 15 bp, Homo sapiens
acattatggttgtat

SEQ ID NO: 486022 - DNA, 15 bp, Homo sapiens
cattatggttgtatc

SEQ ID NO: 486023 - DNA, 15 bp, Homo sapiens
attatggttgtatct

SEQ ID NO: 486024 - DNA, 15 bp, Homo sapiens
ttatggttgtatctg

SEQ ID NO: 486025 - DNA, 15 bp, Homo sapiens
tatggttgtatctgc

SEQ ID NO: 486026 - DNA, 15 bp, Homo sapiens
atggttgtatctgcc

SEQ ID NO: 486027 - DNA, 15 bp, Homo sapiens
tggttgtatctgcca

SEQ ID NO: 486028 - DNA, 15 bp, Homo sapiens
ggttgtatctgccaa

SEQ ID NO: 486029 - DNA, 15 bp, Homo sapiens
gttgtatctgccaag

SEQ ID NO: 486030 - DNA, 15 bp, Homo sapiens
ttgtatctgccaagg

SEQ ID NO: 486031 - DNA, 15 bp, Homo sapiens
tgtatctgccaaggt

SEQ ID NO: 486032 - DNA, 15 bp, Homo sapiens
gtatctgccaaggtg

SEQ ID NO: 486033 - DNA, 15 bp, Homo sapiens
tatctgccaaggtgt

SEQ ID NO: 486034 - DNA, 15 bp, Homo sapiens
atctgccaaggtgtg

SEQ ID NO: 486035 - DNA, 15 bp, Homo sapiens
tctgccaaggtgtgg

SEQ ID NO: 486036 - DNA, 15 bp, Homo sapiens
ctgccaaggtgtgga

SEQ ID NO: 486037 - DNA, 15 bp, Homo sapiens
tgccaaggtgtggaa

SEQ ID NO: 486038 - DNA, 15 bp, Homo sapiens
gccaaggtgtggaaa

SEQ ID NO: 486039 - DNA, 15 bp, Homo sapiens
ccaaggtgtggaaac

SEQ ID NO: 486040 - DNA, 15 bp, Homo sapiens
caaggtgtggaaact

SEQ ID NO: 486041 - DNA, 15 bp, Homo sapiens
aaggtgtggaaactc

SEQ ID NO: 486042 - DNA, 15 bp, Homo sapiens
aggtgtggaaactca

SEQ ID NO: 486043 - DNA, 15 bp, Homo sapiens
ggtgtggaaactcat

SEQ ID NO: 486044 - DNA, 15 bp, Homo sapiens
gtgtggaaactcatt

SEQ ID NO: 486045 - DNA, 15 bp, Homo sapiens
tgtggaaactcattt

SEQ ID NO: 486046 - DNA, 15 bp, Homo sapiens
gtggaaactcattta

SEQ ID NO: 486047 - DNA, 15 bp, Homo sapiens
tggaaactcatttat

SEQ ID NO: 486048 - DNA, 15 bp, Homo sapiens
ggaaactcatttatt

SEQ ID NO: 486049 - DNA, 15 bp, Homo sapiens
gaaactcatttattc

SEQ ID NO: 486050 - DNA, 15 bp, Homo sapiens
aaactcatttattca

SEQ ID NO: 486051 - DNA, 15 bp, Homo sapiens
aactcatttattcac

SEQ ID NO: 486052 - DNA, 15 bp, Homo sapiens
actcatttattcact

SEQ ID NO: 486053 - DNA, 15 bp, Homo sapiens
ctcatttattcactt

SEQ ID NO: 486054 - DNA, 15 bp, Homo sapiens
tcatttattcacttt

SEQ ID NO: 486055 - DNA, 15 bp, Homo sapiens
catttattcactttt

SEQ ID NO: 486056 - DNA, 15 bp, Homo sapiens
atttattcacttttc

SEQ ID NO: 486057 - DNA, 15 bp, Homo sapiens
tttattcacttttct

SEQ ID NO: 486058 - DNA, 15 bp, Homo sapiens
ttattcacttttctt

SEQ ID NO: 486059 - DNA, 15 bp, Homo sapiens
tattcacttttcttc

SEQ ID NO: 486060 - DNA, 15 bp, Homo sapiens
attcacttttcttcg

SEQ ID NO: 486061 - DNA, 15 bp, Homo sapiens
ttcacttttcttcgt

SEQ ID NO: 486062 - DNA, 15 bp, Homo sapiens
tcacttttcttcgtc

SEQ ID NO: 486063 - DNA, 15 bp, Homo sapiens
cacttttcttcgtcc

SEQ ID NO: 486064 - DNA, 15 bp, Homo sapiens
acttttcttcgtcct

SEQ ID NO: 486065 - DNA, 15 bp, Homo sapiens
cttttcttcgtccta

SEQ ID NO: 486066 - DNA, 15 bp, Homo sapiens
ttttcttcgtcctag

SEQ ID NO: 486067 - DNA, 15 bp, Homo sapiens
tttcttcgtcctagt

SEQ ID NO: 486068 - DNA, 15 bp, Homo sapiens
ttcttcgtcctagtc

SEQ ID NO: 486069 - DNA, 15 bp, Homo sapiens
tcttcgtcctagtcc

SEQ ID NO: 486070 - DNA, 15 bp, Homo sapiens
cttcgtcctagtcca

SEQ ID NO: 486071 - DNA, 15 bp, Homo sapiens
ttcgtcctagtccac

SEQ ID NO: 486072 - DNA, 15 bp, Homo sapiens
tcgtcctagtccact

SEQ ID NO: 486073 - DNA, 15 bp, Homo sapiens
cgtcctagtccactt

SEQ ID NO: 486074 - DNA, 15 bp, Homo sapiens
gtcctagtccactta

SEQ ID NO: 486075 - DNA, 15 bp, Homo sapiens
tcctagtccacttag

SEQ ID NO: 486076 - DNA, 15 bp, Homo sapiens
cctagtccacttaga

SEQ ID NO: 486077 - DNA, 15 bp, Homo sapiens
ctagtccacttagac

SEQ ID NO: 486078 - DNA, 15 bp, Homo sapiens
tagtccacttagaca

SEQ ID NO: 486079 - DNA, 15 bp, Homo sapiens
agtccacttagacat

SEQ ID NO: 486080 - DNA, 15 bp, Homo sapiens
gtccacttagacatt

SEQ ID NO: 486081 - DNA, 15 bp, Homo sapiens
tccacttagacattg

SEQ ID NO: 486082 - DNA, 15 bp, Homo sapiens
ccacttagacattgt

SEQ ID NO: 486083 - DNA, 15 bp, Homo sapiens
cacttagacattgtc

SEQ ID NO: 486084 - DNA, 15 bp, Homo sapiens
acttagacattgtct

SEQ ID NO: 486085 - DNA, 15 bp, Homo sapiens
cttagacattgtctt

SEQ ID NO: 486086 - DNA, 15 bp, Homo sapiens
ttagacattgtcttg

SEQ ID NO: 486087 - DNA, 15 bp, Homo sapiens
tagacattgtcttgc

SEQ ID NO: 486088 - DNA, 15 bp, Homo sapiens
agacattgtcttgcc

SEQ ID NO: 486089 - DNA, 15 bp, Homo sapiens
gacattgtcttgcct

SEQ ID NO: 486090 - DNA, 15 bp, Homo sapiens
acattgtcttgcctg

SEQ ID NO: 486091 - DNA, 15 bp, Homo sapiens
cattgtcttgcctgt

SEQ ID NO: 486092 - DNA, 15 bp, Homo sapiens
attgtcttgcctgtc

SEQ ID NO: 486093 - DNA, 15 bp, Homo sapiens
ttgtcttgcctgtcc

SEQ ID NO: 486094 - DNA, 15 bp, Homo sapiens
tgtcttgcctgtccc

SEQ ID NO: 486095 - DNA, 15 bp, Homo sapiens
gtcttgcctgtccca

SEQ ID NO: 486096 - DNA, 15 bp, Homo sapiens
tcttgcctgtcccat

SEQ ID NO: 486097 - DNA, 15 bp, Homo sapiens
cttgcctgtcccatc

SEQ ID NO: 486098 - DNA, 15 bp, Homo sapiens
ttgcctgtcccatca

SEQ ID NO: 486099 - DNA, 15 bp, Homo sapiens
tgcctgtcccatcag

SEQ ID NO: 486100 - DNA, 15 bp, Homo sapiens
gcctgtcccatcaga

SEQ ID NO: 486101 - DNA, 15 bp, Homo sapiens
cctgtcccatcagag

SEQ ID NO: 486102 - DNA, 15 bp, Homo sapiens
ctgtcccatcagagg

SEQ ID NO: 486103 - DNA, 15 bp, Homo sapiens
tgtcccatcagaggc

SEQ ID NO: 486104 - DNA, 15 bp, Homo sapiens
gtcccatcagaggca

SEQ ID NO: 486105 - DNA, 15 bp, Homo sapiens
tcccatcagaggcag

SEQ ID NO: 486106 - DNA, 15 bp, Homo sapiens
cccatcagaggcagc

SEQ ID NO: 486107 - DNA, 15 bp, Homo sapiens
ccatcagaggcagcg

SEQ ID NO: 486108 - DNA, 15 bp, Homo sapiens
catcagaggcagcgg

SEQ ID NO: 486109 - DNA, 15 bp, Homo sapiens
atcagaggcagcggt

SEQ ID NO: 486110 - DNA, 15 bp, Homo sapiens
tcagaggcagcggtc

SEQ ID NO: 486111 - DNA, 15 bp, Homo sapiens
cagaggcagcggtcc

SEQ ID NO: 486112 - DNA, 15 bp, Homo sapiens
agaggcagcggtccc

SEQ ID NO: 486113 - DNA, 15 bp, Homo sapiens
gaggcagcggtccca

SEQ ID NO: 486114 - DNA, 15 bp, Homo sapiens
aggcagcggtcccac

SEQ ID NO: 486115 - DNA, 15 bp, Homo sapiens
ggcagcggtcccacg

SEQ ID NO: 486116 - DNA, 15 bp, Homo sapiens
gcagcggtcccacgc

SEQ ID NO: 486117 - DNA, 15 bp, Homo sapiens
cagcggtcccacgca

SEQ ID NO: 486118 - DNA, 15 bp, Homo sapiens
agcggtcccacgcag

SEQ ID NO: 486119 - DNA, 15 bp, Homo sapiens
gcggtcccacgcagc

SEQ ID NO: 486120 - DNA, 15 bp, Homo sapiens
cggtcccacgcagcc

SEQ ID NO: 486121 - DNA, 15 bp, Homo sapiens
ggtcccacgcagcct

SEQ ID NO: 486122 - DNA, 15 bp, Homo sapiens
gtcccacgcagcctg

SEQ ID NO: 486123 - DNA, 15 bp, Homo sapiens
tcccacgcagcctgt

SEQ ID NO: 486124 - DNA, 15 bp, Homo sapiens
cccacgcagcctgtc

SEQ ID NO: 486125 - DNA, 15 bp, Homo sapiens
ccacgcagcctgtcc

SEQ ID NO: 486126 - DNA, 15 bp, Homo sapiens
cacgcagcctgtcct

SEQ ID NO: 486127 - DNA, 15 bp, Homo sapiens
acgcagcctgtcctt

SEQ ID NO: 486128 - DNA, 15 bp, Homo sapiens
cgcagcctgtccttg

SEQ ID NO: 486129 - DNA, 15 bp, Homo sapiens
gcagcctgtccttgg

SEQ ID NO: 486130 - DNA, 15 bp, Homo sapiens
cagcctgtccttggt

SEQ ID NO: 486131 - DNA, 15 bp, Homo sapiens
agcctgtccttggtc

SEQ ID NO: 486132 - DNA, 15 bp, Homo sapiens
gcctgtccttggtca

SEQ ID NO: 486133 - DNA, 15 bp, Homo sapiens
cctgtccttggtcac

SEQ ID NO: 486134 - DNA, 15 bp, Homo sapiens
ctgtccttggtcaca

SEQ ID NO: 486135 - DNA, 15 bp, Homo sapiens
tgtccttggtcacaa

SEQ ID NO: 486136 - DNA, 15 bp, Homo sapiens
gtccttggtcacaat

SEQ ID NO: 486137 - DNA, 15 bp, Homo sapiens
tccttggtcacaatg

SEQ ID NO: 486138 - DNA, 15 bp, Homo sapiens
ccttggtcacaatgg

SEQ ID NO: 486139 - DNA, 15 bp, Homo sapiens
cttggtcacaatggg

SEQ ID NO: 486140 - DNA, 15 bp, Homo sapiens
ttggtcacaatgggg

SEQ ID NO: 486141 - DNA, 15 bp, Homo sapiens
tggtcacaatgggga

SEQ ID NO: 486142 - DNA, 15 bp, Homo sapiens
ggtcacaatggggac

SEQ ID NO: 486143 - DNA, 15 bp, Homo sapiens
gtcacaatggggacc

SEQ ID NO: 486144 - DNA, 15 bp, Homo sapiens
tcacaatggggacct

SEQ ID NO: 486145 - DNA, 15 bp, Homo sapiens
cacaatggggacctg

SEQ ID NO: 486146 - DNA, 15 bp, Homo sapiens
acaatggggacctgt

SEQ ID NO: 486147 - DNA, 15 bp, Homo sapiens
caatggggacctgtc

SEQ ID NO: 486148 - DNA, 15 bp, Homo sapiens
aatggggacctgtca

SEQ ID NO: 486149 - DNA, 15 bp, Homo sapiens
atggggacctgtcac

SEQ ID NO: 486150 - DNA, 15 bp, Homo sapiens
tggggacctgtcact

SEQ ID NO: 486151 - DNA, 15 bp, Homo sapiens
ggggacctgtcactg

SEQ ID NO: 486152 - DNA, 15 bp, Homo sapiens
gggacctgtcactga

SEQ ID NO: 486153 - DNA, 15 bp, Homo sapiens
ggacctgtcactgat

SEQ ID NO: 486154 - DNA, 15 bp, Homo sapiens
gacctgtcactgatg

SEQ ID NO: 486155 - DNA, 15 bp, Homo sapiens
acctgtcactgatgc

SEQ ID NO: 486156 - DNA, 15 bp, Homo sapiens
cctgtcactgatgct

SEQ ID NO: 486157 - DNA, 15 bp, Homo sapiens
ctgtcactgatgcta

SEQ ID NO: 486158 - DNA, 15 bp, Homo sapiens
tgtcactgatgctag

SEQ ID NO: 486159 - DNA, 15 bp, Homo sapiens
gtcactgatgctagg

SEQ ID NO: 486160 - DNA, 15 bp, Homo sapiens
tcactgatgctagga

SEQ ID NO: 486161 - DNA, 15 bp, Homo sapiens
cactgatgctaggaa

SEQ ID NO: 486162 - DNA, 15 bp, Homo sapiens
actgatgctaggaag

SEQ ID NO: 486163 - DNA, 15 bp, Homo sapiens
ctgatgctaggaagg

SEQ ID NO: 486164 - DNA, 15 bp, Homo sapiens
tgatgctaggaagga

SEQ ID NO: 486165 - DNA, 15 bp, Homo sapiens
gatgctaggaaggac

SEQ ID NO: 486166 - DNA, 15 bp, Homo sapiens
atgctaggaaggact

SEQ ID NO: 486167 - DNA, 15 bp, Homo sapiens
tgctaggaaggactc

SEQ ID NO: 486168 - DNA, 15 bp, Homo sapiens
gctaggaaggactca

SEQ ID NO: 486169 - DNA, 15 bp, Homo sapiens
ctaggaaggactcag

SEQ ID NO: 486170 - DNA, 15 bp, Homo sapiens
taggaaggactcagt

SEQ ID NO: 486171 - DNA, 15 bp, Homo sapiens
aggaaggactcagta

SEQ ID NO: 486172 - DNA, 15 bp, Homo sapiens
ggaaggactcagtaa

SEQ ID NO: 486173 - DNA, 15 bp, Homo sapiens
gaaggactcagtaaa

SEQ ID NO: 486174 - DNA, 15 bp, Homo sapiens
aaggactcagtaaac

SEQ ID NO: 486175 - DNA, 15 bp, Homo sapiens
aggactcagtaaact

SEQ ID NO: 486176 - DNA, 15 bp, Homo sapiens
ggactcagtaaacta

SEQ ID NO: 486177 - DNA, 15 bp, Homo sapiens
gactcagtaaactag

SEQ ID NO: 486178 - DNA, 15 bp, Homo sapiens
actcagtaaactagg

SEQ ID NO: 486179 - DNA, 15 bp, Homo sapiens
ctcagtaaactaggt

SEQ ID NO: 486180 - DNA, 15 bp, Homo sapiens
tcagtaaactaggtg

SEQ ID NO: 486181 - DNA, 15 bp, Homo sapiens
cagtaaactaggtgt

SEQ ID NO: 486182 - DNA, 15 bp, Homo sapiens
agtaaactaggtgtt

SEQ ID NO: 486183 - DNA, 15 bp, Homo sapiens
gtaaactaggtgtta

SEQ ID NO: 486184 - DNA, 15 bp, Homo sapiens
taaactaggtgttaa

SEQ ID NO: 486185 - DNA, 15 bp, Homo sapiens
aaactaggtgttaac

SEQ ID NO: 486186 - DNA, 15 bp, Homo sapiens
aactaggtgttaacc

SEQ ID NO: 486187 - DNA, 15 bp, Homo sapiens
actaggtgttaacca

SEQ ID NO: 486188 - DNA, 15 bp, Homo sapiens
ctaggtgttaaccaa

SEQ ID NO: 486189 - DNA, 15 bp, Homo sapiens
taggtgttaaccaat

SEQ ID NO: 486190 - DNA, 15 bp, Homo sapiens
aggtgttaaccaatg

SEQ ID NO: 486191 - DNA, 15 bp, Homo sapiens
ggtgttaaccaatga

SEQ ID NO: 486192 - DNA, 15 bp, Homo sapiens
gtgttaaccaatgac

SEQ ID NO: 486193 - DNA, 15 bp, Homo sapiens
tgttaaccaatgaca

SEQ ID NO: 486194 - DNA, 15 bp, Homo sapiens
gttaaccaatgacat

SEQ ID NO: 486195 - DNA, 15 bp, Homo sapiens
ttaaccaatgacatt

SEQ ID NO: 486196 - DNA, 15 bp, Homo sapiens
taaccaatgacattt

SEQ ID NO: 486197 - DNA, 15 bp, Homo sapiens
aaccaatgacatttt

SEQ ID NO: 486198 - DNA, 15 bp, Homo sapiens
accaatgacattttg

SEQ ID NO: 486199 - DNA, 15 bp, Homo sapiens
ccaatgacattttgt

SEQ ID NO: 486200 - DNA, 15 bp, Homo sapiens
caatgacattttgtt

SEQ ID NO: 486201 - DNA, 15 bp, Homo sapiens
aatgacattttgtta

SEQ ID NO: 486202 - DNA, 15 bp, Homo sapiens
atgacattttgttat

SEQ ID NO: 486203 - DNA, 15 bp, Homo sapiens
tgacattttgttatc

SEQ ID NO: 486204 - DNA, 15 bp, Homo sapiens
gacattttgttatca

SEQ ID NO: 486205 - DNA, 15 bp, Homo sapiens
acattttgttatcaa

SEQ ID NO: 486206 - DNA, 15 bp, Homo sapiens
cattttgttatcaat

SEQ ID NO: 486207 - DNA, 15 bp, Homo sapiens
attttgttatcaatt

SEQ ID NO: 486208 - DNA, 15 bp, Homo sapiens
ttttgttatcaatta

SEQ ID NO: 486209 - DNA, 15 bp, Homo sapiens
tttgttatcaattaa

SEQ ID NO: 486210 - DNA, 15 bp, Homo sapiens
ttgttatcaattaaa

SEQ ID NO: 486211 - DNA, 15 bp, Homo sapiens
tgttatcaattaaat

SEQ ID NO: 486212 - DNA, 15 bp, Homo sapiens
gttatcaattaaatt

SEQ ID NO: 486213 - DNA, 15 bp, Homo sapiens
ttatcaattaaatta

SEQ ID NO: 486214 - DNA, 15 bp, Homo sapiens
tatcaattaaattaa

SEQ ID NO: 486215 - DNA, 15 bp, Homo sapiens
atcaattaaattaaa

SEQ ID NO: 486216 - DNA, 15 bp, Homo sapiens
tcaattaaattaaaa

SEQ ID NO: 486217 - DNA, 15 bp, Homo sapiens
caattaaattaaaat

SEQ ID NO: 486218 - DNA, 15 bp, Homo sapiens
aattaaattaaaatt

SEQ ID NO: 486219 - DNA, 15 bp, Homo sapiens
attaaattaaaattc

SEQ ID NO: 486220 - DNA, 15 bp, Homo sapiens
ttaaattaaaattct

SEQ ID NO: 486221 - DNA, 15 bp, Homo sapiens
taaattaaaattcta

SEQ ID NO: 486222 - DNA, 15 bp, Homo sapiens
aaattaaaattctag

SEQ ID NO: 486223 - DNA, 15 bp, Homo sapiens
aattaaaattctaga

SEQ ID NO: 486224 - DNA, 15 bp, Homo sapiens
attaaaattctagaa

SEQ ID NO: 486225 - DNA, 15 bp, Homo sapiens
ttaaaattctagaat

SEQ ID NO: 486226 - DNA, 15 bp, Homo sapiens
attctagaattttac

SEQ ID NO: 486227 - DNA, 15 bp, Homo sapiens
ttctagaattttact

SEQ ID NO: 486228 - DNA, 15 bp, Homo sapiens
tctagaattttactg

SEQ ID NO: 486229 - DNA, 15 bp, Homo sapiens
ctagaattttactga

SEQ ID NO: 486230 - DNA, 15 bp, Homo sapiens
tagaattttactgag

SEQ ID NO: 486231 - DNA, 15 bp, Homo sapiens
agaattttactgaga

SEQ ID NO: 486232 - DNA, 15 bp, Homo sapiens
gaattttactgagaa

SEQ ID NO: 486233 - DNA, 15 bp, Homo sapiens
aattttactgagaac

SEQ ID NO: 486234 - DNA, 15 bp, Homo sapiens
attttactgagaacg

SEQ ID NO: 486235 - DNA, 15 bp, Homo sapiens
ttttactgagaacga

SEQ ID NO: 486236 - DNA, 15 bp, Homo sapiens
tttactgagaacgat

SEQ ID NO: 486237 - DNA, 15 bp, Homo sapiens
ttactgagaacgata

SEQ ID NO: 486238 - DNA, 15 bp, Homo sapiens
tactgagaacgatat

SEQ ID NO: 486239 - DNA, 15 bp, Homo sapiens
actgagaacgatata

SEQ ID NO: 486240 - DNA, 15 bp, Homo sapiens
ctgagaacgatatat

SEQ ID NO: 486241 - DNA, 15 bp, Homo sapiens
tgagaacgatatatt

SEQ ID NO: 486242 - DNA, 15 bp, Homo sapiens
gagaacgatatattg

SEQ ID NO: 486243 - DNA, 15 bp, Homo sapiens
agaacgatatattgt

SEQ ID NO: 486244 - DNA, 15 bp, Homo sapiens
gaacgatatattgta

SEQ ID NO: 486245 - DNA, 15 bp, Homo sapiens
aacgatatattgtaa

SEQ ID NO: 486246 - DNA, 15 bp, Homo sapiens
acgatatattgtaac

SEQ ID NO: 486247 - DNA, 15 bp, Homo sapiens
cgatatattgtaacc

SEQ ID NO: 486248 - DNA, 15 bp, Homo sapiens
gatatattgtaacca

SEQ ID NO: 486249 - DNA, 15 bp, Homo sapiens
atatattgtaaccaa

SEQ ID NO: 486250 - DNA, 15 bp, Homo sapiens
tatattgtaaccaaa

SEQ ID NO: 486251 - DNA, 15 bp, Homo sapiens
atattgtaaccaaat

SEQ ID NO: 486252 - DNA, 15 bp, Homo sapiens
tattgtaaccaaatt

SEQ ID NO: 486253 - DNA, 15 bp, Homo sapiens
attgtaaccaaatta

SEQ ID NO: 486254 - DNA, 15 bp, Homo sapiens
ttgtaaccaaattaa

SEQ ID NO: 486255 - DNA, 15 bp, Homo sapiens
tgtaaccaaattaat

SEQ ID NO: 486256 - DNA, 15 bp, Homo sapiens
gtaaccaaattaatt

SEQ ID NO: 486257 - DNA, 15 bp, Homo sapiens
taaccaaattaattt

SEQ ID NO: 486258 - DNA, 15 bp, Homo sapiens
aaccaaattaatttc

SEQ ID NO: 486259 - DNA, 15 bp, Homo sapiens
accaaattaatttct

SEQ ID NO: 486260 - DNA, 15 bp, Homo sapiens
ccaaattaatttctt

SEQ ID NO: 486261 - DNA, 15 bp, Homo sapiens
caaattaatttcttg

SEQ ID NO: 486262 - DNA, 15 bp, Homo sapiens
aaattaatttcttgg

SEQ ID NO: 486263 - DNA, 15 bp, Homo sapiens
aattaatttcttggt

SEQ ID NO: 486264 - DNA, 15 bp, Homo sapiens
attaatttcttggtg

SEQ ID NO: 486265 - DNA, 15 bp, Homo sapiens
ttaatttcttggtgg

SEQ ID NO: 486266 - DNA, 15 bp, Homo sapiens
taatttcttggtggg

SEQ ID NO: 486267 - DNA, 15 bp, Homo sapiens
aatttcttggtggga

SEQ ID NO: 486268 - DNA, 15 bp, Homo sapiens
atttcttggtgggat

SEQ ID NO: 486269 - DNA, 15 bp, Homo sapiens
tttcttggtgggata

SEQ ID NO: 486270 - DNA, 15 bp, Homo sapiens
ttcttggtgggatat

SEQ ID NO: 486271 - DNA, 15 bp, Homo sapiens
tcttggtgggatatc

SEQ ID NO: 486272 - DNA, 15 bp, Homo sapiens
cttggtgggatatct

SEQ ID NO: 486273 - DNA, 15 bp, Homo sapiens
ttggtgggatatctt

SEQ ID NO: 486274 - DNA, 15 bp, Homo sapiens
tggtgggatatcttt

SEQ ID NO: 486275 - DNA, 15 bp, Homo sapiens
ggtgggatatctttt

SEQ ID NO: 486276 - DNA, 15 bp, Homo sapiens
gtgggatatcttttg

SEQ ID NO: 486277 - DNA, 15 bp, Homo sapiens
tgggatatcttttgg

SEQ ID NO: 486278 - DNA, 15 bp, Homo sapiens
gggatatcttttggt

SEQ ID NO: 486279 - DNA, 15 bp, Homo sapiens
ggatatcttttggta

SEQ ID NO: 486280 - DNA, 15 bp, Homo sapiens
gatatcttttggtac

SEQ ID NO: 486281 - DNA, 15 bp, Homo sapiens
atatcttttggtaca

SEQ ID NO: 486282 - DNA, 15 bp, Homo sapiens
tatcttttggtacat

SEQ ID NO: 486283 - DNA, 15 bp, Homo sapiens
atcttttggtacatt

SEQ ID NO: 486284 - DNA, 15 bp, Homo sapiens
tcttttggtacatta

SEQ ID NO: 486285 - DNA, 15 bp, Homo sapiens
cttttggtacattaa

SEQ ID NO: 486286 - DNA, 15 bp, Homo sapiens
ttttggtacattaac

SEQ ID NO: 486287 - DNA, 15 bp, Homo sapiens
tttggtacattaacc

SEQ ID NO: 486288 - DNA, 15 bp, Homo sapiens
ttggtacattaacca

SEQ ID NO: 486289 - DNA, 15 bp, Homo sapiens
tggtacattaaccag

SEQ ID NO: 486290 - DNA, 15 bp, Homo sapiens
ggtacattaaccaga

SEQ ID NO: 486291 - DNA, 15 bp, Homo sapiens
gtacattaaccagaa

SEQ ID NO: 486292 - DNA, 15 bp, Homo sapiens
tacattaaccagaaa

SEQ ID NO: 486293 - DNA, 15 bp, Homo sapiens
acattaaccagaaaa

SEQ ID NO: 486294 - DNA, 15 bp, Homo sapiens
cattaaccagaaaaa

SEQ ID NO: 486295 - DNA, 15 bp, Homo sapiens
attaaccagaaaaaa

SEQ ID NO: 486296 - DNA, 15 bp, Homo sapiens
ttaaccagaaaaaaa

SEQ ID NO: 486297 - DNA, 15 bp, Homo sapiens
taaccagaaaaaaat

SEQ ID NO: 486298 - DNA, 15 bp, Homo sapiens
aaccagaaaaaaatt

SEQ ID NO: 486299 - DNA, 15 bp, Homo sapiens
accagaaaaaaatta

SEQ ID NO: 486300 - DNA, 15 bp, Homo sapiens
ccagaaaaaaattaa

SEQ ID NO: 486301 - DNA, 15 bp, Homo sapiens
cagaaaaaaattaaa

SEQ ID NO: 486302 - DNA, 15 bp, Homo sapiens
agaaaaaaattaaaa

SEQ ID NO: 486303 - DNA, 15 bp, Homo sapiens
gaaaaaaattaaaat

SEQ ID NO: 486304 - DNA, 15 bp, Homo sapiens
aaaaaaattaaaata

SEQ ID NO: 486305 - DNA, 15 bp, Homo sapiens
aaaaaattaaaatat

SEQ ID NO: 486306 - DNA, 15 bp, Homo sapiens
aaaaattaaaatatt

SEQ ID NO: 486307 - DNA, 15 bp, Homo sapiens
aaaattaaaatatta

SEQ ID NO: 486308 - DNA, 15 bp, Homo sapiens
aaattaaaatattag

SEQ ID NO: 486309 - DNA, 15 bp, Homo sapiens
aattaaaatattagc

SEQ ID NO: 486310 - DNA, 15 bp, Homo sapiens
attaaaatattagct

SEQ ID NO: 486311 - DNA, 15 bp, Homo sapiens
aaaatattagctgga

SEQ ID NO: 486312 - DNA, 15 bp, Homo sapiens
aaatattagctggat

SEQ ID NO: 486313 - DNA, 15 bp, Homo sapiens
aatattagctggatg

SEQ ID NO: 486314 - DNA, 15 bp, Homo sapiens
atattagctggatgc

SEQ ID NO: 486315 - DNA, 15 bp, Homo sapiens
tattagctggatgca

SEQ ID NO: 486316 - DNA, 15 bp, Homo sapiens
attagctggatgcag

SEQ ID NO: 486317 - DNA, 15 bp, Homo sapiens
ttagctggatgcagt

SEQ ID NO: 486318 - DNA, 15 bp, Homo sapiens
tagctggatgcagtg

SEQ ID NO: 486319 - DNA, 15 bp, Homo sapiens
agctggatgcagtgg

SEQ ID NO: 486320 - DNA, 15 bp, Homo sapiens
gctggatgcagtggc

SEQ ID NO: 486321 - DNA, 15 bp, Homo sapiens
ctggatgcagtggct

SEQ ID NO: 486322 - DNA, 15 bp, Homo sapiens
tggatgcagtggctc

SEQ ID NO: 486323 - DNA, 15 bp, Homo sapiens
ggatgcagtggctcc

SEQ ID NO: 486324 - DNA, 15 bp, Homo sapiens
gatgcagtggctccc

SEQ ID NO: 486325 - DNA, 15 bp, Homo sapiens
atgcagtggctcccg

SEQ ID NO: 486326 - DNA, 15 bp, Homo sapiens
tgcagtggctcccgc

SEQ ID NO: 486327 - DNA, 15 bp, Homo sapiens
gcagtggctcccgcc

SEQ ID NO: 486328 - DNA, 15 bp, Homo sapiens
cagtggctcccgcct

SEQ ID NO: 486329 - DNA, 15 bp, Homo sapiens
agtggctcccgcctg

SEQ ID NO: 486330 - DNA, 15 bp, Homo sapiens
gctctttgggaggcc

SEQ ID NO: 486331 - DNA, 15 bp, Homo sapiens
ctctttgggaggcca

SEQ ID NO: 486332 - DNA, 15 bp, Homo sapiens
tctttgggaggccat

SEQ ID NO: 486333 - DNA, 15 bp, Homo sapiens
ctttgggaggccatg

SEQ ID NO: 486334 - DNA, 15 bp, Homo sapiens
tttgggaggccatgg

SEQ ID NO: 486335 - DNA, 15 bp, Homo sapiens
ttgggaggccatggt

SEQ ID NO: 486336 - DNA, 15 bp, Homo sapiens
ggaggccatggtgaa

SEQ ID NO: 486337 - DNA, 15 bp, Homo sapiens
gaggccatggtgaaa

SEQ ID NO: 486338 - DNA, 15 bp, Homo sapiens
aggccatggtgaaac

SEQ ID NO: 486339 - DNA, 15 bp, Homo sapiens
ggccatggtgaaacc

SEQ ID NO: 486340 - DNA, 15 bp, Homo sapiens
gccatggtgaaaccc

SEQ ID NO: 486341 - DNA, 15 bp, Homo sapiens
ccatggtgaaacccc

SEQ ID NO: 486342 - DNA, 15 bp, Homo sapiens
gccaggcgtggtgga

SEQ ID NO: 486343 - DNA, 15 bp, Homo sapiens
ccaggcgtggtggag

SEQ ID NO: 486344 - DNA, 15 bp, Homo sapiens
caggcgtggtggagc

SEQ ID NO: 486345 - DNA, 15 bp, Homo sapiens
aggcgtggtggagca

SEQ ID NO: 486346 - DNA, 15 bp, Homo sapiens
ggcgtggtggagcac

SEQ ID NO: 486347 - DNA, 15 bp, Homo sapiens
gcgtggtggagcact

SEQ ID NO: 486348 - DNA, 15 bp, Homo sapiens
cgtggtggagcactc

SEQ ID NO: 486349 - DNA, 15 bp, Homo sapiens
gtggtggagcactcc

SEQ ID NO: 486350 - DNA, 15 bp, Homo sapiens
tggtggagcactcct

SEQ ID NO: 486351 - DNA, 15 bp, Homo sapiens
ggtggagcactcctg

SEQ ID NO: 486352 - DNA, 15 bp, Homo sapiens
gtggagcactcctgt

SEQ ID NO: 486353 - DNA, 15 bp, Homo sapiens
tggagcactcctgta

SEQ ID NO: 486354 - DNA, 15 bp, Homo sapiens
ggagcactcctgtag

SEQ ID NO: 486355 - DNA, 15 bp, Homo sapiens
gagcactcctgtagt

SEQ ID NO: 486356 - DNA, 15 bp, Homo sapiens
agcactcctgtagtc

SEQ ID NO: 486357 - DNA, 15 bp, Homo sapiens
gcactcctgtagtcc

SEQ ID NO: 486358 - DNA, 15 bp, Homo sapiens
cactcctgtagtccc

SEQ ID NO: 486359 - DNA, 15 bp, Homo sapiens
actcctgtagtccca

SEQ ID NO: 486360 - DNA, 15 bp, Homo sapiens
gaattgctggaacct

SEQ ID NO: 486361 - DNA, 15 bp, Homo sapiens
aattgctggaacctg

SEQ ID NO: 486362 - DNA, 15 bp, Homo sapiens
attgctggaacctgg

SEQ ID NO: 486363 - DNA, 15 bp, Homo sapiens
ttgctggaacctggg

SEQ ID NO: 486364 - DNA, 15 bp, Homo sapiens
tgctggaacctggga

SEQ ID NO: 486365 - DNA, 15 bp, Homo sapiens
gctggaacctgggag

SEQ ID NO: 486366 - DNA, 15 bp, Homo sapiens
ctggaacctgggagg

SEQ ID NO: 486367 - DNA, 15 bp, Homo sapiens
tggaacctgggaggc

SEQ ID NO: 486368 - DNA, 15 bp, Homo sapiens
ggaacctgggaggcg

SEQ ID NO: 486369 - DNA, 15 bp, Homo sapiens
tgagccgagatcgca

SEQ ID NO: 486370 - DNA, 15 bp, Homo sapiens
gagccgagatcgcac

SEQ ID NO: 486371 - DNA, 15 bp, Homo sapiens
ccgagatcgcaccaa

SEQ ID NO: 486372 - DNA, 15 bp, Homo sapiens
cgagatcgcaccaat

SEQ ID NO: 486373 - DNA, 15 bp, Homo sapiens
gagatcgcaccaatg

SEQ ID NO: 486374 - DNA, 15 bp, Homo sapiens
agatcgcaccaatgc

SEQ ID NO: 486375 - DNA, 15 bp, Homo sapiens
gatcgcaccaatgca

SEQ ID NO: 486376 - DNA, 15 bp, Homo sapiens
atcgcaccaatgcac

SEQ ID NO: 486377 - DNA, 15 bp, Homo sapiens
tcgcaccaatgcact

SEQ ID NO: 486378 - DNA, 15 bp, Homo sapiens
cgcaccaatgcactc

SEQ ID NO: 486379 - DNA, 15 bp, Homo sapiens
gcaccaatgcactcc

SEQ ID NO: 486380 - DNA, 15 bp, Homo sapiens
caccaatgcactcca

SEQ ID NO: 486381 - DNA, 15 bp, Homo sapiens
accaatgcactccag

SEQ ID NO: 486382 - DNA, 15 bp, Homo sapiens
tccagcctggtgacg

SEQ ID NO: 486383 - DNA, 15 bp, Homo sapiens
ccagcctggtgacgg

SEQ ID NO: 486384 - DNA, 15 bp, Homo sapiens
cagcctggtgacgga

SEQ ID NO: 486385 - DNA, 15 bp, Homo sapiens
agcctggtgacggag

SEQ ID NO: 486386 - DNA, 15 bp, Homo sapiens
gcctggtgacggagg

SEQ ID NO: 486387 - DNA, 15 bp, Homo sapiens
cctggtgacggaggc

SEQ ID NO: 486388 - DNA, 15 bp, Homo sapiens
ctggtgacggaggct

SEQ ID NO: 486389 - DNA, 15 bp, Homo sapiens
tggtgacggaggctc

SEQ ID NO: 486390 - DNA, 15 bp, Homo sapiens
ggtgacggaggctcc

SEQ ID NO: 486391 - DNA, 15 bp, Homo sapiens
gtgacggaggctcca

SEQ ID NO: 486392 - DNA, 15 bp, Homo sapiens
tgacggaggctccat

SEQ ID NO: 486393 - DNA, 15 bp, Homo sapiens
gacggaggctccatc

SEQ ID NO: 486394 - DNA, 15 bp, Homo sapiens
acggaggctccatct

SEQ ID NO: 486395 - DNA, 15 bp, Homo sapiens
cggaggctccatctc

SEQ ID NO: 486396 - DNA, 15 bp, Homo sapiens
ggaggctccatctca

SEQ ID NO: 486397 - DNA, 15 bp, Homo sapiens
gaggctccatctcaa

SEQ ID NO: 486398 - DNA, 15 bp, Homo sapiens
aggctccatctcaaa

SEQ ID NO: 486399 - DNA, 15 bp, Homo sapiens
ggctccatctcaaaa

SEQ ID NO: 486400 - DNA, 15 bp, Homo sapiens
gctccatctcaaaaa

SEQ ID NO: 486401 - DNA, 15 bp, Homo sapiens
catctcaaaaaatat

SEQ ID NO: 486402 - DNA, 15 bp, Homo sapiens
atctcaaaaaatata

SEQ ID NO: 486403 - DNA, 15 bp, Homo sapiens
tctcaaaaaatatat

SEQ ID NO: 486404 - DNA, 15 bp, Homo sapiens
ctcaaaaaatatata

SEQ ID NO: 486405 - DNA, 15 bp, Homo sapiens
tcaaaaaatatatat

SEQ ID NO: 486406 - DNA, 15 bp, Homo sapiens
aaaaatatatatatt

SEQ ID NO: 486407 - DNA, 15 bp, Homo sapiens
aaaatatatatatta

SEQ ID NO: 486408 - DNA, 15 bp, Homo sapiens
aaatatatatattaa

SEQ ID NO: 486409 - DNA, 15 bp, Homo sapiens
aatatatatattaaa

SEQ ID NO: 486410 - DNA, 15 bp, Homo sapiens
atatatatattaaaa

SEQ ID NO: 486411 - DNA, 15 bp, Homo sapiens
tatatattaaaatat

SEQ ID NO: 486412 - DNA, 15 bp, Homo sapiens
atatattaaaatatt

SEQ ID NO: 486413 - DNA, 15 bp, Homo sapiens
tatattaaaatatta

SEQ ID NO: 486414 - DNA, 15 bp, Homo sapiens
atattaaaatattaa

SEQ ID NO: 486415 - DNA, 15 bp, Homo sapiens
attaaaatattaaga

SEQ ID NO: 486416 - DNA, 15 bp, Homo sapiens
ttaaaatattaagat

SEQ ID NO: 486417 - DNA, 15 bp, Homo sapiens
taaaatattaagatt

SEQ ID NO: 486418 - DNA, 15 bp, Homo sapiens
aaaatattaagatta

SEQ ID NO: 486419 - DNA, 15 bp, Homo sapiens
aaatattaagattat

SEQ ID NO: 486420 - DNA, 15 bp, Homo sapiens
aatattaagattatt

SEQ ID NO: 486421 - DNA, 15 bp, Homo sapiens
atattaagattattt

SEQ ID NO: 486422 - DNA, 15 bp, Homo sapiens
tattaagattatttt

SEQ ID NO: 486423 - DNA, 15 bp, Homo sapiens
attaagattattttc

SEQ ID NO: 486424 - DNA, 15 bp, Homo sapiens
aagattattttcata

SEQ ID NO: 486425 - DNA, 15 bp, Homo sapiens
agattattttcatat

SEQ ID NO: 486426 - DNA, 15 bp, Homo sapiens
gattattttcatatt

SEQ ID NO: 486427 - DNA, 15 bp, Homo sapiens
attattttcatattt

SEQ ID NO: 486428 - DNA, 15 bp, Homo sapiens
ttattttcatatttt

SEQ ID NO: 486429 - DNA, 15 bp, Homo sapiens
tattttcatattttt

SEQ ID NO: 486430 - DNA, 15 bp, Homo sapiens
catattttttaaata

SEQ ID NO: 486431 - DNA, 15 bp, Homo sapiens
atattttttaaataa

SEQ ID NO: 486432 - DNA, 15 bp, Homo sapiens
tattttttaaataag

SEQ ID NO: 486433 - DNA, 15 bp, Homo sapiens
attttttaaataaga

SEQ ID NO: 486434 - DNA, 15 bp, Homo sapiens
ttttttaaataagag

SEQ ID NO: 486435 - DNA, 15 bp, Homo sapiens
tttttaaataagaga

SEQ ID NO: 486436 - DNA, 15 bp, Homo sapiens
ttttaaataagagaa

SEQ ID NO: 486437 - DNA, 15 bp, Homo sapiens
tttaaataagagaac

SEQ ID NO: 486438 - DNA, 15 bp, Homo sapiens
ttaaataagagaact

SEQ ID NO: 486439 - DNA, 15 bp, Homo sapiens
taaataagagaacta

SEQ ID NO: 486440 - DNA, 15 bp, Homo sapiens
aaataagagaactat

SEQ ID NO: 486441 - DNA, 15 bp, Homo sapiens
aataagagaactatc

SEQ ID NO: 486442 - DNA, 15 bp, Homo sapiens
ataagagaactatct

SEQ ID NO: 486443 - DNA, 15 bp, Homo sapiens
taagagaactatctt

SEQ ID NO: 486444 - DNA, 15 bp, Homo sapiens
aagagaactatcttg

SEQ ID NO: 486445 - DNA, 15 bp, Homo sapiens
agagaactatcttga

SEQ ID NO: 486446 - DNA, 15 bp, Homo sapiens
gagaactatcttgac

SEQ ID NO: 486447 - DNA, 15 bp, Homo sapiens
agaactatcttgact

SEQ ID NO: 486448 - DNA, 15 bp, Homo sapiens
gaactatcttgacta

SEQ ID NO: 486449 - DNA, 15 bp, Homo sapiens
aactatcttgactat

SEQ ID NO: 486450 - DNA, 15 bp, Homo sapiens
actatcttgactatg

SEQ ID NO: 486451 - DNA, 15 bp, Homo sapiens
ctatcttgactatgg

SEQ ID NO: 486452 - DNA, 15 bp, Homo sapiens
tatcttgactatgga

SEQ ID NO: 486453 - DNA, 15 bp, Homo sapiens
atcttgactatggat

SEQ ID NO: 486454 - DNA, 15 bp, Homo sapiens
tcttgactatggatt

SEQ ID NO: 486455 - DNA, 15 bp, Homo sapiens
cttgactatggatta

SEQ ID NO: 486456 - DNA, 15 bp, Homo sapiens
ttgactatggattat

SEQ ID NO: 486457 - DNA, 15 bp, Homo sapiens
tgactatggattata

SEQ ID NO: 486458 - DNA, 15 bp, Homo sapiens
gactatggattatag

SEQ ID NO: 486459 - DNA, 15 bp, Homo sapiens
actatggattatagg

SEQ ID NO: 486460 - DNA, 15 bp, Homo sapiens
ctatggattatagga

SEQ ID NO: 486461 - DNA, 15 bp, Homo sapiens
tatggattataggat

SEQ ID NO: 486462 - DNA, 15 bp, Homo sapiens
atggattataggata

SEQ ID NO: 486463 - DNA, 15 bp, Homo sapiens
tggattataggataa

SEQ ID NO: 486464 - DNA, 15 bp, Homo sapiens
ggattataggataaa

SEQ ID NO: 486465 - DNA, 15 bp, Homo sapiens
gattataggataaaa

SEQ ID NO: 486466 - DNA, 15 bp, Homo sapiens
attataggataaaaa

SEQ ID NO: 486467 - DNA, 15 bp, Homo sapiens
ttataggataaaaaa

SEQ ID NO: 486468 - DNA, 15 bp, Homo sapiens
tataggataaaaaac

SEQ ID NO: 486469 - DNA, 15 bp, Homo sapiens
ataggataaaaaaca

SEQ ID NO: 486470 - DNA, 15 bp, Homo sapiens
taggataaaaaacac

SEQ ID NO: 486471 - DNA, 15 bp, Homo sapiens
aggataaaaaacaca

SEQ ID NO: 486472 - DNA, 15 bp, Homo sapiens
ggataaaaaacacat

SEQ ID NO: 486473 - DNA, 15 bp, Homo sapiens
gataaaaaacacatc

SEQ ID NO: 486474 - DNA, 15 bp, Homo sapiens
ataaaaaacacatcc

SEQ ID NO: 486475 - DNA, 15 bp, Homo sapiens
taaaaaacacatcct

SEQ ID NO: 486476 - DNA, 15 bp, Homo sapiens
aaaaaacacatccta

SEQ ID NO: 486477 - DNA, 15 bp, Homo sapiens
aaaaacacatcctag

SEQ ID NO: 486478 - DNA, 15 bp, Homo sapiens
aaaacacatcctagt

SEQ ID NO: 486479 - DNA, 15 bp, Homo sapiens
aaacacatcctagtg

SEQ ID NO: 486480 - DNA, 15 bp, Homo sapiens
aacacatcctagtga

SEQ ID NO: 486481 - DNA, 15 bp, Homo sapiens
acacatcctagtgaa

SEQ ID NO: 486482 - DNA, 15 bp, Homo sapiens
cacatcctagtgaaa

SEQ ID NO: 486483 - DNA, 15 bp, Homo sapiens
acatcctagtgaaaa

SEQ ID NO: 486484 - DNA, 15 bp, Homo sapiens
catcctagtgaaaag

SEQ ID NO: 486485 - DNA, 15 bp, Homo sapiens
atcctagtgaaaagt

SEQ ID NO: 486486 - DNA, 15 bp, Homo sapiens
tcctagtgaaaagta

SEQ ID NO: 486487 - DNA, 15 bp, Homo sapiens
cctagtgaaaagtat

SEQ ID NO: 486488 - DNA, 15 bp, Homo sapiens
ctagtgaaaagtatc

SEQ ID NO: 486489 - DNA, 15 bp, Homo sapiens
tagtgaaaagtatct

SEQ ID NO: 486490 - DNA, 15 bp, Homo sapiens
agtgaaaagtatctt

SEQ ID NO: 486491 - DNA, 15 bp, Homo sapiens
gtgaaaagtatctta

SEQ ID NO: 486492 - DNA, 15 bp, Homo sapiens
tgaaaagtatcttaa

SEQ ID NO: 486493 - DNA, 15 bp, Homo sapiens
gaaaagtatcttaaa

SEQ ID NO: 486494 - DNA, 15 bp, Homo sapiens
aaaagtatcttaaat

SEQ ID NO: 486495 - DNA, 15 bp, Homo sapiens
aaagtatcttaaata

SEQ ID NO: 486496 - DNA, 15 bp, Homo sapiens
aagtatcttaaataa

SEQ ID NO: 486497 - DNA, 15 bp, Homo sapiens
agtatcttaaataag

SEQ ID NO: 486498 - DNA, 15 bp, Homo sapiens
gtatcttaaataaga

SEQ ID NO: 486499 - DNA, 15 bp, Homo sapiens
tatcttaaataagat

SEQ ID NO: 486500 - DNA, 15 bp, Homo sapiens
atcttaaataagatg

SEQ ID NO: 486501 - DNA, 15 bp, Homo sapiens
tcttaaataagatgc

SEQ ID NO: 486502 - DNA, 15 bp, Homo sapiens
cttaaataagatgcc

SEQ ID NO: 486503 - DNA, 15 bp, Homo sapiens
ttaaataagatgcct

SEQ ID NO: 486504 - DNA, 15 bp, Homo sapiens
taaataagatgcctt

SEQ ID NO: 486505 - DNA, 15 bp, Homo sapiens
aaataagatgccttt

SEQ ID NO: 486506 - DNA, 15 bp, Homo sapiens
aataagatgccttta

SEQ ID NO: 486507 - DNA, 15 bp, Homo sapiens
ataagatgcctttac

SEQ ID NO: 486508 - DNA, 15 bp, Homo sapiens
taagatgcctttact

SEQ ID NO: 486509 - DNA, 15 bp, Homo sapiens
aagatgcctttactt

SEQ ID NO: 486510 - DNA, 15 bp, Homo sapiens
agatgcctttacttt

SEQ ID NO: 486511 - DNA, 15 bp, Homo sapiens
gatgcctttactttt

SEQ ID NO: 486512 - DNA, 15 bp, Homo sapiens
atgcctttacttttg

SEQ ID NO: 486513 - DNA, 15 bp, Homo sapiens
tgcctttacttttgt

SEQ ID NO: 486514 - DNA, 15 bp, Homo sapiens
gcctttacttttgtg

SEQ ID NO: 486515 - DNA, 15 bp, Homo sapiens
cctttacttttgtgg

SEQ ID NO: 486516 - DNA, 15 bp, Homo sapiens
ctttacttttgtggc

SEQ ID NO: 486517 - DNA, 15 bp, Homo sapiens
tttacttttgtggca

SEQ ID NO: 486518 - DNA, 15 bp, Homo sapiens
ttacttttgtggcag

SEQ ID NO: 486519 - DNA, 15 bp, Homo sapiens
tacttttgtggcagg

SEQ ID NO: 486520 - DNA, 15 bp, Homo sapiens
acttttgtggcagga

SEQ ID NO: 486521 - DNA, 15 bp, Homo sapiens
cttttgtggcaggat

SEQ ID NO: 486522 - DNA, 15 bp, Homo sapiens
ttttgtggcaggata

SEQ ID NO: 486523 - DNA, 15 bp, Homo sapiens
tttgtggcaggataa

SEQ ID NO: 486524 - DNA, 15 bp, Homo sapiens
ttgtggcaggataag

SEQ ID NO: 486525 - DNA, 15 bp, Homo sapiens
tgtggcaggataagc

SEQ ID NO: 486526 - DNA, 15 bp, Homo sapiens
gtggcaggataagct

SEQ ID NO: 486527 - DNA, 15 bp, Homo sapiens
tggcaggataagctg

SEQ ID NO: 486528 - DNA, 15 bp, Homo sapiens
ggcaggataagctgg

SEQ ID NO: 486529 - DNA, 15 bp, Homo sapiens
gcaggataagctggc

SEQ ID NO: 486530 - DNA, 15 bp, Homo sapiens
caggataagctggcc

SEQ ID NO: 486531 - DNA, 15 bp, Homo sapiens
aggataagctggcct

SEQ ID NO: 486532 - DNA, 15 bp, Homo sapiens
ggataagctggccta

SEQ ID NO: 486533 - DNA, 15 bp, Homo sapiens
gataagctggcctaa

SEQ ID NO: 486534 - DNA, 15 bp, Homo sapiens
ataagctggcctaag

SEQ ID NO: 486535 - DNA, 15 bp, Homo sapiens
taagctggcctaagc

SEQ ID NO: 486536 - DNA, 15 bp, Homo sapiens
aagctggcctaagct

SEQ ID NO: 486537 - DNA, 15 bp, Homo sapiens
agctggcctaagctg

SEQ ID NO: 486538 - DNA, 15 bp, Homo sapiens
gctggcctaagctga

SEQ ID NO: 486539 - DNA, 15 bp, Homo sapiens
ctggcctaagctgaa

SEQ ID NO: 486540 - DNA, 15 bp, Homo sapiens
tggcctaagctgaag

SEQ ID NO: 486541 - DNA, 15 bp, Homo sapiens
ggcctaagctgaagt

SEQ ID NO: 486542 - DNA, 15 bp, Homo sapiens
gcctaagctgaagtc

SEQ ID NO: 486543 - DNA, 15 bp, Homo sapiens
cctaagctgaagtct

SEQ ID NO: 486544 - DNA, 15 bp, Homo sapiens
ctaagctgaagtctc

SEQ ID NO: 486545 - DNA, 15 bp, Homo sapiens
taagctgaagtctcc

SEQ ID NO: 486546 - DNA, 15 bp, Homo sapiens
aagctgaagtctcca

SEQ ID NO: 486547 - DNA, 15 bp, Homo sapiens
agctgaagtctccaa

SEQ ID NO: 486548 - DNA, 15 bp, Homo sapiens
gctgaagtctccaaa

SEQ ID NO: 486549 - DNA, 15 bp, Homo sapiens
ctgaagtctccaaaa

SEQ ID NO: 486550 - DNA, 15 bp, Homo sapiens
tgaagtctccaaaaa

SEQ ID NO: 486551 - DNA, 15 bp, Homo sapiens
gaagtctccaaaaag

SEQ ID NO: 486552 - DNA, 15 bp, Homo sapiens
aagtctccaaaaaga

SEQ ID NO: 486553 - DNA, 15 bp, Homo sapiens
agtctccaaaaagaa

SEQ ID NO: 486554 - DNA, 15 bp, Homo sapiens
gtctccaaaaagaaa

SEQ ID NO: 486555 - DNA, 15 bp, Homo sapiens
tctccaaaaagaaag

SEQ ID NO: 486556 - DNA, 15 bp, Homo sapiens
ctccaaaaagaaagg

SEQ ID NO: 486557 - DNA, 15 bp, Homo sapiens
tccaaaaagaaagga

SEQ ID NO: 486558 - DNA, 15 bp, Homo sapiens
ccaaaaagaaaggag

SEQ ID NO: 486559 - DNA, 15 bp, Homo sapiens
caaaaagaaaggagg

SEQ ID NO: 486560 - DNA, 15 bp, Homo sapiens
aaaaagaaaggagga

SEQ ID NO: 486561 - DNA, 15 bp, Homo sapiens
aaaagaaaggaggac

SEQ ID NO: 486562 - DNA, 15 bp, Homo sapiens
aaagaaaggaggaca

SEQ ID NO: 486563 - DNA, 15 bp, Homo sapiens
aagaaaggaggacag

SEQ ID NO: 486564 - DNA, 15 bp, Homo sapiens
agaaaggaggacaga

SEQ ID NO: 486565 - DNA, 15 bp, Homo sapiens
gaaaggaggacagaa

SEQ ID NO: 486566 - DNA, 15 bp, Homo sapiens
aaaggaggacagaaa

SEQ ID NO: 486567 - DNA, 15 bp, Homo sapiens
aaggaggacagaaaa

SEQ ID NO: 486568 - DNA, 15 bp, Homo sapiens
aggaggacagaaaaa

SEQ ID NO: 486569 - DNA, 15 bp, Homo sapiens
ggaggacagaaaaag

SEQ ID NO: 486570 - DNA, 15 bp, Homo sapiens
gaggacagaaaaaga

SEQ ID NO: 486571 - DNA, 15 bp, Homo sapiens
aggacagaaaaagaa

SEQ ID NO: 486572 - DNA, 15 bp, Homo sapiens
ggacagaaaaagaaa

SEQ ID NO: 486573 - DNA, 15 bp, Homo sapiens
gacagaaaaagaaat

SEQ ID NO: 486574 - DNA, 15 bp, Homo sapiens
acagaaaaagaaatt

SEQ ID NO: 486575 - DNA, 15 bp, Homo sapiens
cagaaaaagaaattg

SEQ ID NO: 486576 - DNA, 15 bp, Homo sapiens
agaaaaagaaattgg

SEQ ID NO: 486577 - DNA, 15 bp, Homo sapiens
gaaaaagaaattggt

SEQ ID NO: 486578 - DNA, 15 bp, Homo sapiens
aaaaagaaattggtg

SEQ ID NO: 486579 - DNA, 15 bp, Homo sapiens
aaaagaaattggtga

SEQ ID NO: 486580 - DNA, 15 bp, Homo sapiens
aaagaaattggtgaa

SEQ ID NO: 486581 - DNA, 15 bp, Homo sapiens
aagaaattggtgaaa

SEQ ID NO: 486582 - DNA, 15 bp, Homo sapiens
agaaattggtgaaat

SEQ ID NO: 486583 - DNA, 15 bp, Homo sapiens
gaaattggtgaaatt

SEQ ID NO: 486584 - DNA, 15 bp, Homo sapiens
aaattggtgaaattt

SEQ ID NO: 486585 - DNA, 15 bp, Homo sapiens
aattggtgaaatttt

SEQ ID NO: 486586 - DNA, 15 bp, Homo sapiens
attggtgaaattttt

SEQ ID NO: 486587 - DNA, 15 bp, Homo sapiens
ttggtgaaatttttt

SEQ ID NO: 486588 - DNA, 15 bp, Homo sapiens
tggtgaaattttttt

SEQ ID NO: 486589 - DNA, 15 bp, Homo sapiens
ggtgaaatttttttt

SEQ ID NO: 486590 - DNA, 15 bp, Homo sapiens
gtgaaattttttttg

SEQ ID NO: 486591 - DNA, 15 bp, Homo sapiens
tgaaattttttttgt

SEQ ID NO: 486592 - DNA, 15 bp, Homo sapiens
gaaattttttttgta

SEQ ID NO: 486593 - DNA, 15 bp, Homo sapiens
aaattttttttgtat

SEQ ID NO: 486594 - DNA, 15 bp, Homo sapiens
attttttttgtatga

SEQ ID NO: 486595 - DNA, 15 bp, Homo sapiens
ttttttttgtatgaa

SEQ ID NO: 486596 - DNA, 15 bp, Homo sapiens
tttttttgtatgaaa

SEQ ID NO: 486597 - DNA, 15 bp, Homo sapiens
ttttttgtatgaaaa

SEQ ID NO: 486598 - DNA, 15 bp, Homo sapiens
tttttgtatgaaaac

SEQ ID NO: 486599 - DNA, 15 bp, Homo sapiens
ttttgtatgaaaaca

SEQ ID NO: 486600 - DNA, 15 bp, Homo sapiens
tttgtatgaaaacat

SEQ ID NO: 486601 - DNA, 15 bp, Homo sapiens
ttgtatgaaaacata

SEQ ID NO: 486602 - DNA, 15 bp, Homo sapiens
tgtatgaaaacatac

SEQ ID NO: 486603 - DNA, 15 bp, Homo sapiens
gtatgaaaacatacc

SEQ ID NO: 486604 - DNA, 15 bp, Homo sapiens
tatgaaaacatacct

SEQ ID NO: 486605 - DNA, 15 bp, Homo sapiens
atgaaaacatacctg

SEQ ID NO: 486606 - DNA, 15 bp, Homo sapiens
tgaaaacatacctgt

SEQ ID NO: 486607 - DNA, 15 bp, Homo sapiens
gaaaacatacctgtg

SEQ ID NO: 486608 - DNA, 15 bp, Homo sapiens
aaaacatacctgtgg

SEQ ID NO: 486609 - DNA, 15 bp, Homo sapiens
aaacatacctgtggt

SEQ ID NO: 486610 - DNA, 15 bp, Homo sapiens
aacatacctgtggtg

SEQ ID NO: 486611 - DNA, 15 bp, Homo sapiens
acatacctgtggtgc

SEQ ID NO: 486612 - DNA, 15 bp, Homo sapiens
catacctgtggtgca

SEQ ID NO: 486613 - DNA, 15 bp, Homo sapiens
atacctgtggtgcaa

SEQ ID NO: 486614 - DNA, 15 bp, Homo sapiens
tacctgtggtgcaaa

SEQ ID NO: 486615 - DNA, 15 bp, Homo sapiens
acctgtggtgcaaaa

SEQ ID NO: 486616 - DNA, 15 bp, Homo sapiens
cctgtggtgcaaaaa

SEQ ID NO: 486617 - DNA, 15 bp, Homo sapiens
ctgtggtgcaaaaat

SEQ ID NO: 486618 - DNA, 15 bp, Homo sapiens
tgtggtgcaaaaata

SEQ ID NO: 486619 - DNA, 15 bp, Homo sapiens
gtggtgcaaaaataa

SEQ ID NO: 486620 - DNA, 15 bp, Homo sapiens
tggtgcaaaaataat

SEQ ID NO: 486621 - DNA, 15 bp, Homo sapiens
ggtgcaaaaataata

SEQ ID NO: 486622 - DNA, 15 bp, Homo sapiens
gtgcaaaaataatag

SEQ ID NO: 486623 - DNA, 15 bp, Homo sapiens
tgcaaaaataataga

SEQ ID NO: 486624 - DNA, 15 bp, Homo sapiens
gcaaaaataatagat

SEQ ID NO: 486625 - DNA, 15 bp, Homo sapiens
caaaaataatagatt

SEQ ID NO: 486626 - DNA, 15 bp, Homo sapiens
aaaaataatagattt

SEQ ID NO: 486627 - DNA, 15 bp, Homo sapiens
aaaataatagatttc

SEQ ID NO: 486628 - DNA, 15 bp, Homo sapiens
aaataatagatttct

SEQ ID NO: 486629 - DNA, 15 bp, Homo sapiens
aataatagatttctc

SEQ ID NO: 486630 - DNA, 15 bp, Homo sapiens
ataatagatttctca

SEQ ID NO: 486631 - DNA, 15 bp, Homo sapiens
taatagatttctcat

SEQ ID NO: 486632 - DNA, 15 bp, Homo sapiens
aatagatttctcatt

SEQ ID NO: 486633 - DNA, 15 bp, Homo sapiens
atagatttctcattc

SEQ ID NO: 486634 - DNA, 15 bp, Homo sapiens
tagatttctcattca

SEQ ID NO: 486635 - DNA, 15 bp, Homo sapiens
agatttctcattcaa

SEQ ID NO: 486636 - DNA, 15 bp, Homo sapiens
gatttctcattcaaa

SEQ ID NO: 486637 - DNA, 15 bp, Homo sapiens
atttctcattcaaac

SEQ ID NO: 486638 - DNA, 15 bp, Homo sapiens
tttctcattcaaaca

SEQ ID NO: 486639 - DNA, 15 bp, Homo sapiens
ttctcattcaaacac

SEQ ID NO: 486640 - DNA, 15 bp, Homo sapiens
tctcattcaaacact

SEQ ID NO: 486641 - DNA, 15 bp, Homo sapiens
ctcattcaaacactg

SEQ ID NO: 486642 - DNA, 15 bp, Homo sapiens
tcattcaaacactga

SEQ ID NO: 486643 - DNA, 15 bp, Homo sapiens
cattcaaacactgaa

SEQ ID NO: 486644 - DNA, 15 bp, Homo sapiens
attcaaacactgaaa

SEQ ID NO: 486645 - DNA, 15 bp, Homo sapiens
ttcaaacactgaaat

SEQ ID NO: 486646 - DNA, 15 bp, Homo sapiens
tcaaacactgaaata

SEQ ID NO: 486647 - DNA, 15 bp, Homo sapiens
caaacactgaaataa

SEQ ID NO: 486648 - DNA, 15 bp, Homo sapiens
aaacactgaaataat

SEQ ID NO: 486649 - DNA, 15 bp, Homo sapiens
aacactgaaataata

SEQ ID NO: 486650 - DNA, 15 bp, Homo sapiens
acactgaaataataa

SEQ ID NO: 486651 - DNA, 15 bp, Homo sapiens
cactgaaataataag

SEQ ID NO: 486652 - DNA, 15 bp, Homo sapiens
actgaaataataaga

SEQ ID NO: 486653 - DNA, 15 bp, Homo sapiens
ctgaaataataagac

SEQ ID NO: 486654 - DNA, 15 bp, Homo sapiens
tgaaataataagacc

SEQ ID NO: 486655 - DNA, 15 bp, Homo sapiens
gaaataataagacca

SEQ ID NO: 486656 - DNA, 15 bp, Homo sapiens
aaataataagaccat

SEQ ID NO: 486657 - DNA, 15 bp, Homo sapiens
aataataagaccata

SEQ ID NO: 486658 - DNA, 15 bp, Homo sapiens
ataataagaccatat

SEQ ID NO: 486659 - DNA, 15 bp, Homo sapiens
taataagaccatatt

SEQ ID NO: 486660 - DNA, 15 bp, Homo sapiens
aataagaccatatta

SEQ ID NO: 486661 - DNA, 15 bp, Homo sapiens
ataagaccatattac

SEQ ID NO: 486662 - DNA, 15 bp, Homo sapiens
taagaccatattact

SEQ ID NO: 486663 - DNA, 15 bp, Homo sapiens
aagaccatattactt

SEQ ID NO: 486664 - DNA, 15 bp, Homo sapiens
agaccatattacttg

SEQ ID NO: 486665 - DNA, 15 bp, Homo sapiens
gaccatattacttgt

SEQ ID NO: 486666 - DNA, 15 bp, Homo sapiens
accatattacttgtt

SEQ ID NO: 486667 - DNA, 15 bp, Homo sapiens
ccatattacttgttt

SEQ ID NO: 486668 - DNA, 15 bp, Homo sapiens
catattacttgtttt

SEQ ID NO: 486669 - DNA, 15 bp, Homo sapiens
atattacttgttttt

SEQ ID NO: 486670 - DNA, 15 bp, Homo sapiens
tattacttgtttttc

SEQ ID NO: 486671 - DNA, 15 bp, Homo sapiens
attacttgtttttca

SEQ ID NO: 486672 - DNA, 15 bp, Homo sapiens
ttacttgtttttcag

SEQ ID NO: 486673 - DNA, 15 bp, Homo sapiens
tacttgtttttcagt

SEQ ID NO: 486674 - DNA, 15 bp, Homo sapiens
acttgtttttcagtc

SEQ ID NO: 486675 - DNA, 15 bp, Homo sapiens
cttgtttttcagtct

SEQ ID NO: 486676 - DNA, 15 bp, Homo sapiens
ttgtttttcagtctc

SEQ ID NO: 486677 - DNA, 15 bp, Homo sapiens
tgtttttcagtctca

SEQ ID NO: 486678 - DNA, 15 bp, Homo sapiens
gtttttcagtctcat

SEQ ID NO: 486679 - DNA, 15 bp, Homo sapiens
tttttcagtctcata

SEQ ID NO: 486680 - DNA, 15 bp, Homo sapiens
ttttcagtctcatat

SEQ ID NO: 486681 - DNA, 15 bp, Homo sapiens
tttcagtctcatatt

SEQ ID NO: 486682 - DNA, 15 bp, Homo sapiens
ttcagtctcatattt

SEQ ID NO: 486683 - DNA, 15 bp, Homo sapiens
tcagtctcatatttt

SEQ ID NO: 486684 - DNA, 15 bp, Homo sapiens
cagtctcatattttt

SEQ ID NO: 486685 - DNA, 15 bp, Homo sapiens
agtctcatatttttc

SEQ ID NO: 486686 - DNA, 15 bp, Homo sapiens
gtctcatatttttca

SEQ ID NO: 486687 - DNA, 15 bp, Homo sapiens
tctcatatttttcag

SEQ ID NO: 486688 - DNA, 15 bp, Homo sapiens
ctcatatttttcagt

SEQ ID NO: 486689 - DNA, 15 bp, Homo sapiens
tcatatttttcagtc

SEQ ID NO: 486690 - DNA, 15 bp, Homo sapiens
catatttttcagtcc

SEQ ID NO: 486691 - DNA, 15 bp, Homo sapiens
atatttttcagtccc

SEQ ID NO: 486692 - DNA, 15 bp, Homo sapiens
tatttttcagtcccc

SEQ ID NO: 486693 - DNA, 15 bp, Homo sapiens
atttttcagtcccct

SEQ ID NO: 486694 - DNA, 15 bp, Homo sapiens
tttttcagtcccctg

SEQ ID NO: 486695 - DNA, 15 bp, Homo sapiens
ttttcagtcccctgg

SEQ ID NO: 486696 - DNA, 15 bp, Homo sapiens
tttcagtcccctggt

SEQ ID NO: 486697 - DNA, 15 bp, Homo sapiens
ttcagtcccctggtg

SEQ ID NO: 486698 - DNA, 15 bp, Homo sapiens
tcagtcccctggtgt

SEQ ID NO: 486699 - DNA, 15 bp, Homo sapiens
cagtcccctggtgtg

SEQ ID NO: 486700 - DNA, 15 bp, Homo sapiens
agtcccctggtgtgt

SEQ ID NO: 486701 - DNA, 15 bp, Homo sapiens
gtcccctggtgtgtg

SEQ ID NO: 486702 - DNA, 15 bp, Homo sapiens
tcccctggtgtgtgg

SEQ ID NO: 486703 - DNA, 15 bp, Homo sapiens
cccctggtgtgtgga

SEQ ID NO: 486704 - DNA, 15 bp, Homo sapiens
ccctggtgtgtggat

SEQ ID NO: 486705 - DNA, 15 bp, Homo sapiens
cctggtgtgtggatt

SEQ ID NO: 486706 - DNA, 15 bp, Homo sapiens
ctggtgtgtggattc

SEQ ID NO: 486707 - DNA, 15 bp, Homo sapiens
tggtgtgtggattct

SEQ ID NO: 486708 - DNA, 15 bp, Homo sapiens
ggtgtgtggattctt

SEQ ID NO: 486709 - DNA, 15 bp, Homo sapiens
gtgtgtggattcttt

SEQ ID NO: 486710 - DNA, 15 bp, Homo sapiens
tgtgtggattctttc

SEQ ID NO: 486711 - DNA, 15 bp, Homo sapiens
gtgtggattctttct

SEQ ID NO: 486712 - DNA, 15 bp, Homo sapiens
tgtggattctttcta

SEQ ID NO: 486713 - DNA, 15 bp, Homo sapiens
gtggattctttctac

SEQ ID NO: 486714 - DNA, 15 bp, Homo sapiens
tggattctttctaca

SEQ ID NO: 486715 - DNA, 15 bp, Homo sapiens
ggattctttctacac

SEQ ID NO: 486716 - DNA, 15 bp, Homo sapiens
gattctttctacaca

SEQ ID NO: 486717 - DNA, 15 bp, Homo sapiens
attctttctacacaa

SEQ ID NO: 486718 - DNA, 15 bp, Homo sapiens
ttctttctacacaaa

SEQ ID NO: 486719 - DNA, 15 bp, Homo sapiens
tctttctacacaaac

SEQ ID NO: 486720 - DNA, 15 bp, Homo sapiens
ctttctacacaaaca

SEQ ID NO: 486721 - DNA, 15 bp, Homo sapiens
tttctacacaaacaa

SEQ ID NO: 486722 - DNA, 15 bp, Homo sapiens
ttctacacaaacaaa

SEQ ID NO: 486723 - DNA, 15 bp, Homo sapiens
tctacacaaacaaac

SEQ ID NO: 486724 - DNA, 15 bp, Homo sapiens
ctacacaaacaaaca

SEQ ID NO: 486725 - DNA, 15 bp, Homo sapiens
tacacaaacaaacag

SEQ ID NO: 486726 - DNA, 15 bp, Homo sapiens
acacaaacaaacagc

SEQ ID NO: 486727 - DNA, 15 bp, Homo sapiens
cacaaacaaacagct

SEQ ID NO: 486728 - DNA, 15 bp, Homo sapiens
acaaacaaacagcta

SEQ ID NO: 486729 - DNA, 15 bp, Homo sapiens
caaacaaacagctag

SEQ ID NO: 486730 - DNA, 15 bp, Homo sapiens
aaacaaacagctagt

SEQ ID NO: 486731 - DNA, 15 bp, Homo sapiens
aacaaacagctagta

SEQ ID NO: 486732 - DNA, 15 bp, Homo sapiens
acaaacagctagtac

SEQ ID NO: 486733 - DNA, 15 bp, Homo sapiens
caaacagctagtacg

SEQ ID NO: 486734 - DNA, 15 bp, Homo sapiens
aaacagctagtacgt

SEQ ID NO: 486735 - DNA, 15 bp, Homo sapiens
aacagctagtacgtg

SEQ ID NO: 486736 - DNA, 15 bp, Homo sapiens
acagctagtacgtgt

SEQ ID NO: 486737 - DNA, 15 bp, Homo sapiens
cagctagtacgtgtc

SEQ ID NO: 486738 - DNA, 15 bp, Homo sapiens
agctagtacgtgtca

SEQ ID NO: 486739 - DNA, 15 bp, Homo sapiens
gctagtacgtgtcaa

SEQ ID NO: 486740 - DNA, 15 bp, Homo sapiens
ctagtacgtgtcaat

SEQ ID NO: 486741 - DNA, 15 bp, Homo sapiens
tagtacgtgtcaatt

SEQ ID NO: 486742 - DNA, 15 bp, Homo sapiens
agtacgtgtcaatta

SEQ ID NO: 486743 - DNA, 15 bp, Homo sapiens
gtacgtgtcaattat

SEQ ID NO: 486744 - DNA, 15 bp, Homo sapiens
tacgtgtcaattatg

SEQ ID NO: 486745 - DNA, 15 bp, Homo sapiens
acgtgtcaattatgt

SEQ ID NO: 486746 - DNA, 15 bp, Homo sapiens
cgtgtcaattatgta

SEQ ID NO: 486747 - DNA, 15 bp, Homo sapiens
gtgtcaattatgtaa

SEQ ID NO: 486748 - DNA, 15 bp, Homo sapiens
tgtcaattatgtaaa

SEQ ID NO: 486749 - DNA, 15 bp, Homo sapiens
gtcaattatgtaaaa

SEQ ID NO: 486750 - DNA, 15 bp, Homo sapiens
tcaattatgtaaaat

SEQ ID NO: 486751 - DNA, 15 bp, Homo sapiens
caattatgtaaaatt

SEQ ID NO: 486752 - DNA, 15 bp, Homo sapiens
aattatgtaaaatta

SEQ ID NO: 486753 - DNA, 15 bp, Homo sapiens
ttatgtaaaattata

SEQ ID NO: 486754 - DNA, 15 bp, Homo sapiens
tatgtaaaattatat

SEQ ID NO: 486755 - DNA, 15 bp, Homo sapiens
atgtaaaattatatt

SEQ ID NO: 486756 - DNA, 15 bp, Homo sapiens
tgtaaaattatatta

SEQ ID NO: 486757 - DNA, 15 bp, Homo sapiens
gtaaaattatattac

SEQ ID NO: 486758 - DNA, 15 bp, Homo sapiens
taaaattatattacc

SEQ ID NO: 486759 - DNA, 15 bp, Homo sapiens
aaaattatattacca

SEQ ID NO: 486760 - DNA, 15 bp, Homo sapiens
aaattatattaccaa

SEQ ID NO: 486761 - DNA, 15 bp, Homo sapiens
aattatattaccaac

SEQ ID NO: 486762 - DNA, 15 bp, Homo sapiens
attatattaccaaca

SEQ ID NO: 486763 - DNA, 15 bp, Homo sapiens
ttatattaccaacac

SEQ ID NO: 486764 - DNA, 15 bp, Homo sapiens
tatattaccaacact

SEQ ID NO: 486765 - DNA, 15 bp, Homo sapiens
atattaccaacactc

SEQ ID NO: 486766 - DNA, 15 bp, Homo sapiens
tattaccaacactca

SEQ ID NO: 486767 - DNA, 15 bp, Homo sapiens
attaccaacactcaa

SEQ ID NO: 486768 - DNA, 15 bp, Homo sapiens
ttaccaacactcaag

SEQ ID NO: 486769 - DNA, 15 bp, Homo sapiens
taccaacactcaagc

SEQ ID NO: 486770 - DNA, 15 bp, Homo sapiens
accaacactcaagca

SEQ ID NO: 486771 - DNA, 15 bp, Homo sapiens
ccaacactcaagcaa

SEQ ID NO: 486772 - DNA, 15 bp, Homo sapiens
caacactcaagcaaa

SEQ ID NO: 486773 - DNA, 15 bp, Homo sapiens
aacactcaagcaaaa

SEQ ID NO: 486774 - DNA, 15 bp, Homo sapiens
acactcaagcaaaaa

SEQ ID NO: 486775 - DNA, 15 bp, Homo sapiens
cactcaagcaaaaat

SEQ ID NO: 486776 - DNA, 15 bp, Homo sapiens
actcaagcaaaaatg

SEQ ID NO: 486777 - DNA, 15 bp, Homo sapiens
ctcaagcaaaaatgt

SEQ ID NO: 486778 - DNA, 15 bp, Homo sapiens
tcaagcaaaaatgtt

SEQ ID NO: 486779 - DNA, 15 bp, Homo sapiens
caagcaaaaatgttt

SEQ ID NO: 486780 - DNA, 15 bp, Homo sapiens
aagcaaaaatgtttt

SEQ ID NO: 486781 - DNA, 15 bp, Homo sapiens
agcaaaaatgttttg

SEQ ID NO: 486782 - DNA, 15 bp, Homo sapiens
gcaaaaatgttttgg

SEQ ID NO: 486783 - DNA, 15 bp, Homo sapiens
caaaaatgttttggg

SEQ ID NO: 486784 - DNA, 15 bp, Homo sapiens
aaaaatgttttgggt

SEQ ID NO: 486785 - DNA, 15 bp, Homo sapiens
aaaatgttttgggta

SEQ ID NO: 486786 - DNA, 15 bp, Homo sapiens
aaatgttttgggtat

SEQ ID NO: 486787 - DNA, 15 bp, Homo sapiens
aatgttttgggtata

SEQ ID NO: 486788 - DNA, 15 bp, Homo sapiens
atgttttgggtatat

SEQ ID NO: 486789 - DNA, 15 bp, Homo sapiens
tgttttgggtatatt

SEQ ID NO: 486790 - DNA, 15 bp, Homo sapiens
gttttgggtatattc

SEQ ID NO: 486791 - DNA, 15 bp, Homo sapiens
ttttgggtatattcc

SEQ ID NO: 486792 - DNA, 15 bp, Homo sapiens
tttgggtatattccc

SEQ ID NO: 486793 - DNA, 15 bp, Homo sapiens
ttgggtatattcccc

SEQ ID NO: 486794 - DNA, 15 bp, Homo sapiens
tgggtatattcccct

SEQ ID NO: 486795 - DNA, 15 bp, Homo sapiens
gggtatattccccta

SEQ ID NO: 486796 - DNA, 15 bp, Homo sapiens
ggtatattcccctaa

SEQ ID NO: 486797 - DNA, 15 bp, Homo sapiens
gtatattcccctaaa

SEQ ID NO: 486798 - DNA, 15 bp, Homo sapiens
tatattcccctaaaa

SEQ ID NO: 486799 - DNA, 15 bp, Homo sapiens
atattcccctaaaat

SEQ ID NO: 486800 - DNA, 15 bp, Homo sapiens
tattcccctaaaatt

SEQ ID NO: 486801 - DNA, 15 bp, Homo sapiens
attcccctaaaattg

SEQ ID NO: 486802 - DNA, 15 bp, Homo sapiens
ttcccctaaaattgt

SEQ ID NO: 486803 - DNA, 15 bp, Homo sapiens
tcccctaaaattgtc

SEQ ID NO: 486804 - DNA, 15 bp, Homo sapiens
cccctaaaattgtcc

SEQ ID NO: 486805 - DNA, 15 bp, Homo sapiens
ccctaaaattgtcct

SEQ ID NO: 486806 - DNA, 15 bp, Homo sapiens
cctaaaattgtcctt

SEQ ID NO: 486807 - DNA, 15 bp, Homo sapiens
ctaaaattgtccttt

SEQ ID NO: 486808 - DNA, 15 bp, Homo sapiens
taaaattgtcctttg

SEQ ID NO: 486809 - DNA, 15 bp, Homo sapiens
aaaattgtcctttgc

SEQ ID NO: 486810 - DNA, 15 bp, Homo sapiens
aaattgtcctttgca

SEQ ID NO: 486811 - DNA, 15 bp, Homo sapiens
aattgtcctttgcaa

SEQ ID NO: 486812 - DNA, 15 bp, Homo sapiens
attgtcctttgcaat

SEQ ID NO: 486813 - DNA, 15 bp, Homo sapiens
ttgtcctttgcaatg

SEQ ID NO: 486814 - DNA, 15 bp, Homo sapiens
tgtcctttgcaatgg

SEQ ID NO: 486815 - DNA, 15 bp, Homo sapiens
gtcctttgcaatggg

SEQ ID NO: 486816 - DNA, 15 bp, Homo sapiens
tcctttgcaatggga

SEQ ID NO: 486817 - DNA, 15 bp, Homo sapiens
cctttgcaatgggaa

SEQ ID NO: 486818 - DNA, 15 bp, Homo sapiens
ctttgcaatgggaaa

SEQ ID NO: 486819 - DNA, 15 bp, Homo sapiens
tttgcaatgggaaat

SEQ ID NO: 486820 - DNA, 15 bp, Homo sapiens
ttgcaatgggaaatc

SEQ ID NO: 486821 - DNA, 15 bp, Homo sapiens
tgcaatgggaaatct

SEQ ID NO: 486822 - DNA, 15 bp, Homo sapiens
gcaatgggaaatctt

SEQ ID NO: 486823 - DNA, 15 bp, Homo sapiens
caatgggaaatcttt

SEQ ID NO: 486824 - DNA, 15 bp, Homo sapiens
aatgggaaatctttt

SEQ ID NO: 486825 - DNA, 15 bp, Homo sapiens
atgggaaatcttttc

SEQ ID NO: 486826 - DNA, 15 bp, Homo sapiens
tgggaaatcttttca

SEQ ID NO: 486827 - DNA, 15 bp, Homo sapiens
gggaaatcttttcac

SEQ ID NO: 486828 - DNA, 15 bp, Homo sapiens
ggaaatcttttcaca

SEQ ID NO: 486829 - DNA, 15 bp, Homo sapiens
gaaatcttttcacat

SEQ ID NO: 486830 - DNA, 15 bp, Homo sapiens
aaatcttttcacatt

SEQ ID NO: 486831 - DNA, 15 bp, Homo sapiens
aatcttttcacattg

SEQ ID NO: 486832 - DNA, 15 bp, Homo sapiens
atcttttcacattga

SEQ ID NO: 486833 - DNA, 15 bp, Homo sapiens
tcttttcacattgat

SEQ ID NO: 486834 - DNA, 15 bp, Homo sapiens
cttttcacattgata

SEQ ID NO: 486835 - DNA, 15 bp, Homo sapiens
ttttcacattgatat

SEQ ID NO: 486836 - DNA, 15 bp, Homo sapiens
tttcacattgatatt

SEQ ID NO: 486837 - DNA, 15 bp, Homo sapiens
ttcacattgatattt

SEQ ID NO: 486838 - DNA, 15 bp, Homo sapiens
tcacattgatattta

SEQ ID NO: 486839 - DNA, 15 bp, Homo sapiens
cacattgatatttag

SEQ ID NO: 486840 - DNA, 15 bp, Homo sapiens
acattgatatttaga

SEQ ID NO: 486841 - DNA, 15 bp, Homo sapiens
cattgatatttagag

SEQ ID NO: 486842 - DNA, 15 bp, Homo sapiens
attgatatttagagg

SEQ ID NO: 486843 - DNA, 15 bp, Homo sapiens
ttgatatttagaggc

SEQ ID NO: 486844 - DNA, 15 bp, Homo sapiens
tgatatttagaggct

SEQ ID NO: 486845 - DNA, 15 bp, Homo sapiens
gatatttagaggctg

SEQ ID NO: 486846 - DNA, 15 bp, Homo sapiens
atatttagaggctgg

SEQ ID NO: 486847 - DNA, 15 bp, Homo sapiens
tatttagaggctggt

SEQ ID NO: 486848 - DNA, 15 bp, Homo sapiens
atttagaggctggtt

SEQ ID NO: 486849 - DNA, 15 bp, Homo sapiens
tttagaggctggttg

SEQ ID NO: 486850 - DNA, 15 bp, Homo sapiens
ttagaggctggttgg

SEQ ID NO: 486851 - DNA, 15 bp, Homo sapiens
tagaggctggttgga

SEQ ID NO: 486852 - DNA, 15 bp, Homo sapiens
agaggctggttggag

SEQ ID NO: 486853 - DNA, 15 bp, Homo sapiens
gaggctggttggagt

SEQ ID NO: 486854 - DNA, 15 bp, Homo sapiens
aggctggttggagta

SEQ ID NO: 486855 - DNA, 15 bp, Homo sapiens
ggctggttggagtat

SEQ ID NO: 486856 - DNA, 15 bp, Homo sapiens
gctggttggagtatt

SEQ ID NO: 486857 - DNA, 15 bp, Homo sapiens
ctggttggagtattt

SEQ ID NO: 486858 - DNA, 15 bp, Homo sapiens
tggttggagtatttc

SEQ ID NO: 486859 - DNA, 15 bp, Homo sapiens
ggttggagtatttcc

SEQ ID NO: 486860 - DNA, 15 bp, Homo sapiens
gttggagtatttcct

SEQ ID NO: 486861 - DNA, 15 bp, Homo sapiens
ttggagtatttcctc

SEQ ID NO: 486862 - DNA, 15 bp, Homo sapiens
tggagtatttcctcc

SEQ ID NO: 486863 - DNA, 15 bp, Homo sapiens
ggagtatttcctcct

SEQ ID NO: 486864 - DNA, 15 bp, Homo sapiens
gagtatttcctcctg

SEQ ID NO: 486865 - DNA, 15 bp, Homo sapiens
agtatttcctcctga

SEQ ID NO: 486866 - DNA, 15 bp, Homo sapiens
gtatttcctcctgaa

SEQ ID NO: 486867 - DNA, 15 bp, Homo sapiens
tatttcctcctgaat

SEQ ID NO: 486868 - DNA, 15 bp, Homo sapiens
atttcctcctgaatt

SEQ ID NO: 486869 - DNA, 15 bp, Homo sapiens
tttcctcctgaattt

SEQ ID NO: 486870 - DNA, 15 bp, Homo sapiens
ttcctcctgaatttg

SEQ ID NO: 486871 - DNA, 15 bp, Homo sapiens
tcctcctgaatttgg

SEQ ID NO: 486872 - DNA, 15 bp, Homo sapiens
cctcctgaatttggg

SEQ ID NO: 486873 - DNA, 15 bp, Homo sapiens
ctcctgaatttgggt

SEQ ID NO: 486874 - DNA, 15 bp, Homo sapiens
tcctgaatttgggtt

SEQ ID NO: 486875 - DNA, 15 bp, Homo sapiens
cctgaatttgggttt

SEQ ID NO: 486876 - DNA, 15 bp, Homo sapiens
ctgaatttgggtttt

SEQ ID NO: 486877 - DNA, 15 bp, Homo sapiens
tgaatttgggtttta

SEQ ID NO: 486878 - DNA, 15 bp, Homo sapiens
gaatttgggttttag

SEQ ID NO: 486879 - DNA, 15 bp, Homo sapiens
aatttgggttttagt

SEQ ID NO: 486880 - DNA, 15 bp, Homo sapiens
atttgggttttagtg

SEQ ID NO: 486881 - DNA, 15 bp, Homo sapiens
tttgggttttagtgg

SEQ ID NO: 486882 - DNA, 15 bp, Homo sapiens
ttgggttttagtgga

SEQ ID NO: 486883 - DNA, 15 bp, Homo sapiens
tgggttttagtggaa

SEQ ID NO: 486884 - DNA, 15 bp, Homo sapiens
gggttttagtggaag

SEQ ID NO: 486885 - DNA, 15 bp, Homo sapiens
ggttttagtggaagg

SEQ ID NO: 486886 - DNA, 15 bp, Homo sapiens
gttttagtggaaggc

SEQ ID NO: 486887 - DNA, 15 bp, Homo sapiens
ttttagtggaaggct

SEQ ID NO: 486888 - DNA, 15 bp, Homo sapiens
tttagtggaaggcta

SEQ ID NO: 486889 - DNA, 15 bp, Homo sapiens
ttagtggaaggctag

SEQ ID NO: 486890 - DNA, 15 bp, Homo sapiens
tagtggaaggctaga

SEQ ID NO: 486891 - DNA, 15 bp, Homo sapiens
agtggaaggctagac

SEQ ID NO: 486892 - DNA, 15 bp, Homo sapiens
gtggaaggctagaca

SEQ ID NO: 486893 - DNA, 15 bp, Homo sapiens
tggaaggctagacat

SEQ ID NO: 486894 - DNA, 15 bp, Homo sapiens
ggaaggctagacatt

SEQ ID NO: 486895 - DNA, 15 bp, Homo sapiens
gaaggctagacatta

SEQ ID NO: 486896 - DNA, 15 bp, Homo sapiens
aaggctagacattaa

SEQ ID NO: 486897 - DNA, 15 bp, Homo sapiens
aggctagacattaat

SEQ ID NO: 486898 - DNA, 15 bp, Homo sapiens
ggctagacattaatt

SEQ ID NO: 486899 - DNA, 15 bp, Homo sapiens
gctagacattaattt

SEQ ID NO: 486900 - DNA, 15 bp, Homo sapiens
ctagacattaatttg

SEQ ID NO: 486901 - DNA, 15 bp, Homo sapiens
tagacattaatttga

SEQ ID NO: 486902 - DNA, 15 bp, Homo sapiens
agacattaatttgag

SEQ ID NO: 486903 - DNA, 15 bp, Homo sapiens
gacattaatttgaga

SEQ ID NO: 486904 - DNA, 15 bp, Homo sapiens
acattaatttgagaa

SEQ ID NO: 486905 - DNA, 15 bp, Homo sapiens
cattaatttgagaag

SEQ ID NO: 486906 - DNA, 15 bp, Homo sapiens
attaatttgagaagc

SEQ ID NO: 486907 - DNA, 15 bp, Homo sapiens
ttaatttgagaagct

SEQ ID NO: 486908 - DNA, 15 bp, Homo sapiens
taatttgagaagctt

SEQ ID NO: 486909 - DNA, 15 bp, Homo sapiens
aatttgagaagcttt

SEQ ID NO: 486910 - DNA, 15 bp, Homo sapiens
atttgagaagctttg

SEQ ID NO: 486911 - DNA, 15 bp, Homo sapiens
tttgagaagctttgt

SEQ ID NO: 486912 - DNA, 15 bp, Homo sapiens
ttgagaagctttgtt

SEQ ID NO: 486913 - DNA, 15 bp, Homo sapiens
tgagaagctttgttg

SEQ ID NO: 486914 - DNA, 15 bp, Homo sapiens
gagaagctttgttgt

SEQ ID NO: 486915 - DNA, 15 bp, Homo sapiens
agaagctttgttgtt

SEQ ID NO: 486916 - DNA, 15 bp, Homo sapiens
gaagctttgttgttc

SEQ ID NO: 486917 - DNA, 15 bp, Homo sapiens
aagctttgttgttct

SEQ ID NO: 486918 - DNA, 15 bp, Homo sapiens
agctttgttgttctc

SEQ ID NO: 486919 - DNA, 15 bp, Homo sapiens
gctttgttgttctct

SEQ ID NO: 486920 - DNA, 15 bp, Homo sapiens
ctttgttgttctctt

SEQ ID NO: 486921 - DNA, 15 bp, Homo sapiens
tttgttgttctcttt

SEQ ID NO: 486922 - DNA, 15 bp, Homo sapiens
ttgttgttctcttta

SEQ ID NO: 486923 - DNA, 15 bp, Homo sapiens
tgttgttctctttat

SEQ ID NO: 486924 - DNA, 15 bp, Homo sapiens
gttgttctctttatt

SEQ ID NO: 486925 - DNA, 15 bp, Homo sapiens
ttgttctctttattt

SEQ ID NO: 486926 - DNA, 15 bp, Homo sapiens
tgttctctttatttg

SEQ ID NO: 486927 - DNA, 15 bp, Homo sapiens
gttctctttatttgc

SEQ ID NO: 486928 - DNA, 15 bp, Homo sapiens
ttctctttatttgct

SEQ ID NO: 486929 - DNA, 15 bp, Homo sapiens
tctctttatttgctg

SEQ ID NO: 486930 - DNA, 15 bp, Homo sapiens
ctctttatttgctgt

SEQ ID NO: 486931 - DNA, 15 bp, Homo sapiens
tctttatttgctgtc

SEQ ID NO: 486932 - DNA, 15 bp, Homo sapiens
ctttatttgctgtca

SEQ ID NO: 486933 - DNA, 15 bp, Homo sapiens
tttatttgctgtcac

SEQ ID NO: 486934 - DNA, 15 bp, Homo sapiens
ttatttgctgtcaca

SEQ ID NO: 486935 - DNA, 15 bp, Homo sapiens
tatttgctgtcacag

SEQ ID NO: 486936 - DNA, 15 bp, Homo sapiens
atttgctgtcacagc

SEQ ID NO: 486937 - DNA, 15 bp, Homo sapiens
tttgctgtcacagcg

SEQ ID NO: 486938 - DNA, 15 bp, Homo sapiens
ttgctgtcacagcgg

SEQ ID NO: 486939 - DNA, 15 bp, Homo sapiens
tgctgtcacagcggg

SEQ ID NO: 486940 - DNA, 15 bp, Homo sapiens
gctgtcacagcggga

SEQ ID NO: 486941 - DNA, 15 bp, Homo sapiens
ctgtcacagcgggag

SEQ ID NO: 486942 - DNA, 15 bp, Homo sapiens
tgtcacagcgggaga

SEQ ID NO: 486943 - DNA, 15 bp, Homo sapiens
gtcacagcgggagag

SEQ ID NO: 486944 - DNA, 15 bp, Homo sapiens
tcacagcgggagagg

SEQ ID NO: 486945 - DNA, 15 bp, Homo sapiens
cacagcgggagagga

SEQ ID NO: 486946 - DNA, 15 bp, Homo sapiens
acagcgggagaggac

SEQ ID NO: 486947 - DNA, 15 bp, Homo sapiens
cagcgggagaggacc

SEQ ID NO: 486948 - DNA, 15 bp, Homo sapiens
agcgggagaggacct

SEQ ID NO: 486949 - DNA, 15 bp, Homo sapiens
gcgggagaggacctg

SEQ ID NO: 486950 - DNA, 15 bp, Homo sapiens
cgggagaggacctgc

SEQ ID NO: 486951 - DNA, 15 bp, Homo sapiens
gggagaggacctgct

SEQ ID NO: 486952 - DNA, 15 bp, Homo sapiens
ggagaggacctgctg

SEQ ID NO: 486953 - DNA, 15 bp, Homo sapiens
gagaggacctgctgg

SEQ ID NO: 486954 - DNA, 15 bp, Homo sapiens
agaggacctgctggc

SEQ ID NO: 486955 - DNA, 15 bp, Homo sapiens
gaggacctgctggcc

SEQ ID NO: 486956 - DNA, 15 bp, Homo sapiens
aggacctgctggccc

SEQ ID NO: 486957 - DNA, 15 bp, Homo sapiens
ggacctgctggcccc

SEQ ID NO: 486958 - DNA, 15 bp, Homo sapiens
gacctgctggcccca

SEQ ID NO: 486959 - DNA, 15 bp, Homo sapiens
acctgctggccccac

SEQ ID NO: 486960 - DNA, 15 bp, Homo sapiens
cctgctggccccacc

SEQ ID NO: 486961 - DNA, 15 bp, Homo sapiens
ctgctggccccaccg

SEQ ID NO: 486962 - DNA, 15 bp, Homo sapiens
tgctggccccaccgc

SEQ ID NO: 486963 - DNA, 15 bp, Homo sapiens
gctggccccaccgca

SEQ ID NO: 486964 - DNA, 15 bp, Homo sapiens
ctggccccaccgcac

SEQ ID NO: 486965 - DNA, 15 bp, Homo sapiens
tggccccaccgcacg

SEQ ID NO: 486966 - DNA, 15 bp, Homo sapiens
ggccccaccgcacga

SEQ ID NO: 486967 - DNA, 15 bp, Homo sapiens
gccccaccgcacgac

SEQ ID NO: 486968 - DNA, 15 bp, Homo sapiens
ccccaccgcacgaca

SEQ ID NO: 486969 - DNA, 15 bp, Homo sapiens
cccaccgcacgacac

SEQ ID NO: 486970 - DNA, 15 bp, Homo sapiens
ccaccgcacgacacc

SEQ ID NO: 486971 - DNA, 15 bp, Homo sapiens
caccgcacgacacca

SEQ ID NO: 486972 - DNA, 15 bp, Homo sapiens
accgcacgacaccag

SEQ ID NO: 486973 - DNA, 15 bp, Homo sapiens
ccgcacgacaccagc

SEQ ID NO: 486974 - DNA, 15 bp, Homo sapiens
cgcacgacaccagca

SEQ ID NO: 486975 - DNA, 15 bp, Homo sapiens
gcacgacaccagcac

SEQ ID NO: 486976 - DNA, 15 bp, Homo sapiens
cacgacaccagcacg

SEQ ID NO: 486977 - DNA, 15 bp, Homo sapiens
acgacaccagcacgg

SEQ ID NO: 486978 - DNA, 15 bp, Homo sapiens
cgacaccagcacgga

SEQ ID NO: 486979 - DNA, 15 bp, Homo sapiens
gacaccagcacggat

SEQ ID NO: 486980 - DNA, 15 bp, Homo sapiens
acaccagcacggatc

SEQ ID NO: 486981 - DNA, 15 bp, Homo sapiens
caccagcacggatct

SEQ ID NO: 486982 - DNA, 15 bp, Homo sapiens
accagcacggatctc

SEQ ID NO: 486983 - DNA, 15 bp, Homo sapiens
ccagcacggatctca

SEQ ID NO: 486984 - DNA, 15 bp, Homo sapiens
cagcacggatctcac

SEQ ID NO: 486985 - DNA, 15 bp, Homo sapiens
agcacggatctcacg

SEQ ID NO: 486986 - DNA, 15 bp, Homo sapiens
gcacggatctcacgg

SEQ ID NO: 486987 - DNA, 15 bp, Homo sapiens
cacggatctcacgga

SEQ ID NO: 486988 - DNA, 15 bp, Homo sapiens
acggatctcacggag

SEQ ID NO: 486989 - DNA, 15 bp, Homo sapiens
cggatctcacggagg

SEQ ID NO: 486990 - DNA, 15 bp, Homo sapiens
ggatctcacggaggt

SEQ ID NO: 486991 - DNA, 15 bp, Homo sapiens
gatctcacggaggtc

SEQ ID NO: 486992 - DNA, 15 bp, Homo sapiens
atctcacggaggtca

SEQ ID NO: 486993 - DNA, 15 bp, Homo sapiens
tctcacggaggtcat

SEQ ID NO: 486994 - DNA, 15 bp, Homo sapiens
ctcacggaggtcatg

SEQ ID NO: 486995 - DNA, 15 bp, Homo sapiens
tcacggaggtcatgg

SEQ ID NO: 486996 - DNA, 15 bp, Homo sapiens
cacggaggtcatgga

SEQ ID NO: 486997 - DNA, 15 bp, Homo sapiens
acggaggtcatggag

SEQ ID NO: 486998 - DNA, 15 bp, Homo sapiens
cggaggtcatggagc

SEQ ID NO: 486999 - DNA, 15 bp, Homo sapiens
ggaggtcatggagca

SEQ ID NO: 487000 - DNA, 15 bp, Homo sapiens
gaggtcatggagcag

SEQ ID NO: 487001 - DNA, 15 bp, Homo sapiens
aggtcatggagcaga

SEQ ID NO: 487002 - DNA, 15 bp, Homo sapiens
ggtcatggagcagat

SEQ ID NO: 487003 - DNA, 15 bp, Homo sapiens
gtcatggagcagatt

SEQ ID NO: 487004 - DNA, 15 bp, Homo sapiens
tcatggagcagattc

SEQ ID NO: 487005 - DNA, 15 bp, Homo sapiens
catggagcagattca

SEQ ID NO: 487006 - DNA, 15 bp, Homo sapiens
atggagcagattcac

SEQ ID NO: 487007 - DNA, 15 bp, Homo sapiens
tggagcagattcaca

SEQ ID NO: 487008 - DNA, 15 bp, Homo sapiens
ggagcagattcacag

SEQ ID NO: 487009 - DNA, 15 bp, Homo sapiens
gagcagattcacagc

SEQ ID NO: 487010 - DNA, 15 bp, Homo sapiens
agcagattcacagca

SEQ ID NO: 487011 - DNA, 15 bp, Homo sapiens
gcagattcacagcac

SEQ ID NO: 487012 - DNA, 15 bp, Homo sapiens
cagattcacagcacg

SEQ ID NO: 487013 - DNA, 15 bp, Homo sapiens
agattcacagcacgt

SEQ ID NO: 487014 - DNA, 15 bp, Homo sapiens
gattcacagcacgtt

SEQ ID NO: 487015 - DNA, 15 bp, Homo sapiens
attcacagcacgttt

SEQ ID NO: 487016 - DNA, 15 bp, Homo sapiens
ttcacagcacgtttc

SEQ ID NO: 487017 - DNA, 15 bp, Homo sapiens
tcacagcacgtttcc

SEQ ID NO: 487018 - DNA, 15 bp, Homo sapiens
cacagcacgtttcca

SEQ ID NO: 487019 - DNA, 15 bp, Homo sapiens
acagcacgtttccat

SEQ ID NO: 487020 - DNA, 15 bp, Homo sapiens
cagcacgtttccatc

SEQ ID NO: 487021 - DNA, 15 bp, Homo sapiens
agcacgtttccatct

SEQ ID NO: 487022 - DNA, 15 bp, Homo sapiens
gcacgtttccatctt

SEQ ID NO: 487023 - DNA, 15 bp, Homo sapiens
cacgtttccatcttg

SEQ ID NO: 487024 - DNA, 15 bp, Homo sapiens
acgtttccatcttgc

SEQ ID NO: 487025 - DNA, 15 bp, Homo sapiens
cgtttccatcttgct

SEQ ID NO: 487026 - DNA, 15 bp, Homo sapiens
gtttccatcttgctg

SEQ ID NO: 487027 - DNA, 15 bp, Homo sapiens
tttccatcttgctgc

SEQ ID NO: 487028 - DNA, 15 bp, Homo sapiens
ttccatcttgctgcc

SEQ ID NO: 487029 - DNA, 15 bp, Homo sapiens
tccatcttgctgccg

SEQ ID NO: 487030 - DNA, 15 bp, Homo sapiens
ccatcttgctgccgt

SEQ ID NO: 487031 - DNA, 15 bp, Homo sapiens
catcttgctgccgtg

SEQ ID NO: 487032 - DNA, 15 bp, Homo sapiens
atcttgctgccgtga

SEQ ID NO: 487033 - DNA, 15 bp, Homo sapiens
tcttgctgccgtgag

SEQ ID NO: 487034 - DNA, 15 bp, Homo sapiens
cttgctgccgtgagt

SEQ ID NO: 487035 - DNA, 15 bp, Homo sapiens
ttgctgccgtgagta

SEQ ID NO: 487036 - DNA, 15 bp, Homo sapiens
tgctgccgtgagtat

SEQ ID NO: 487037 - DNA, 15 bp, Homo sapiens
gctgccgtgagtatg

SEQ ID NO: 487038 - DNA, 15 bp, Homo sapiens
ctgccgtgagtatga

SEQ ID NO: 487039 - DNA, 15 bp, Homo sapiens
tgccgtgagtatgaa

SEQ ID NO: 487040 - DNA, 15 bp, Homo sapiens
gccgtgagtatgaaa

SEQ ID NO: 487041 - DNA, 15 bp, Homo sapiens
ccgtgagtatgaaag

SEQ ID NO: 487042 - DNA, 15 bp, Homo sapiens
cgtgagtatgaaaga

SEQ ID NO: 487043 - DNA, 15 bp, Homo sapiens
gtgagtatgaaagat

SEQ ID NO: 487044 - DNA, 15 bp, Homo sapiens
tgagtatgaaagatt

SEQ ID NO: 487045 - DNA, 15 bp, Homo sapiens
gagtatgaaagattg

SEQ ID NO: 487046 - DNA, 15 bp, Homo sapiens
agtatgaaagattgc

SEQ ID NO: 487047 - DNA, 15 bp, Homo sapiens
gtatgaaagattgca

SEQ ID NO: 487048 - DNA, 15 bp, Homo sapiens
tatgaaagattgcag

SEQ ID NO: 487049 - DNA, 15 bp, Homo sapiens
atgaaagattgcagc

SEQ ID NO: 487050 - DNA, 15 bp, Homo sapiens
tgaaagattgcagca

SEQ ID NO: 487051 - DNA, 15 bp, Homo sapiens
gaaagattgcagcac

SEQ ID NO: 487052 - DNA, 15 bp, Homo sapiens
aaagattgcagcacc

SEQ ID NO: 487053 - DNA, 15 bp, Homo sapiens
aagattgcagcacca

SEQ ID NO: 487054 - DNA, 15 bp, Homo sapiens
agattgcagcaccac

SEQ ID NO: 487055 - DNA, 15 bp, Homo sapiens
gattgcagcaccaca

SEQ ID NO: 487056 - DNA, 15 bp, Homo sapiens
attgcagcaccacag

SEQ ID NO: 487057 - DNA, 15 bp, Homo sapiens
ttgcagcaccacagc

SEQ ID NO: 487058 - DNA, 15 bp, Homo sapiens
tgcagcaccacagct

SEQ ID NO: 487059 - DNA, 15 bp, Homo sapiens
gcagcaccacagctg

SEQ ID NO: 487060 - DNA, 15 bp, Homo sapiens
cagcaccacagctgc

SEQ ID NO: 487061 - DNA, 15 bp, Homo sapiens
agcaccacagctgca

SEQ ID NO: 487062 - DNA, 15 bp, Homo sapiens
gcaccacagctgcac

SEQ ID NO: 487063 - DNA, 15 bp, Homo sapiens
caccacagctgcacg

SEQ ID NO: 487064 - DNA, 15 bp, Homo sapiens
accacagctgcacgt

SEQ ID NO: 487065 - DNA, 15 bp, Homo sapiens
ccacagctgcacgtg

SEQ ID NO: 487066 - DNA, 15 bp, Homo sapiens
cacagctgcacgtgt

SEQ ID NO: 487067 - DNA, 15 bp, Homo sapiens
acagctgcacgtgtt

SEQ ID NO: 487068 - DNA, 15 bp, Homo sapiens
cagctgcacgtgttc

SEQ ID NO: 487069 - DNA, 15 bp, Homo sapiens
agctgcacgtgttcc

SEQ ID NO: 487070 - DNA, 15 bp, Homo sapiens
gctgcacgtgttcct

SEQ ID NO: 487071 - DNA, 15 bp, Homo sapiens
ctgcacgtgttcctt

SEQ ID NO: 487072 - DNA, 15 bp, Homo sapiens
tgcacgtgttccttc

SEQ ID NO: 487073 - DNA, 15 bp, Homo sapiens
gcacgtgttccttcc

SEQ ID NO: 487074 - DNA, 15 bp, Homo sapiens
cacgtgttccttccc

SEQ ID NO: 487075 - DNA, 15 bp, Homo sapiens
acgtgttccttccct

SEQ ID NO: 487076 - DNA, 15 bp, Homo sapiens
cgtgttccttccctt

SEQ ID NO: 487077 - DNA, 15 bp, Homo sapiens
gtgttccttcccttt

SEQ ID NO: 487078 - DNA, 15 bp, Homo sapiens
tgttccttccctttc

SEQ ID NO: 487079 - DNA, 15 bp, Homo sapiens
gttccttccctttct

SEQ ID NO: 487080 - DNA, 15 bp, Homo sapiens
ttccttccctttctc

SEQ ID NO: 487081 - DNA, 15 bp, Homo sapiens
tccttccctttctct

SEQ ID NO: 487082 - DNA, 15 bp, Homo sapiens
ccttccctttctctt

SEQ ID NO: 487083 - DNA, 15 bp, Homo sapiens
cttccctttctcttt

SEQ ID NO: 487084 - DNA, 15 bp, Homo sapiens
ttccctttctctttt

SEQ ID NO: 487085 - DNA, 15 bp, Homo sapiens
tccctttctcttttt

SEQ ID NO: 487086 - DNA, 15 bp, Homo sapiens
ccctttctctttttc

SEQ ID NO: 487087 - DNA, 15 bp, Homo sapiens
cctttctctttttct

SEQ ID NO: 487088 - DNA, 15 bp, Homo sapiens
tttctctttttctgc

SEQ ID NO: 487089 - DNA, 15 bp, Homo sapiens
ttctctttttctgca

SEQ ID NO: 487090 - DNA, 15 bp, Homo sapiens
tctctttttctgcat

SEQ ID NO: 487091 - DNA, 15 bp, Homo sapiens
ctctttttctgcatg

SEQ ID NO: 487092 - DNA, 15 bp, Homo sapiens
tctttttctgcatgc

SEQ ID NO: 487093 - DNA, 15 bp, Homo sapiens
ctttttctgcatgcg

SEQ ID NO: 487094 - DNA, 15 bp, Homo sapiens
tttttctgcatgcgg

SEQ ID NO: 487095 - DNA, 15 bp, Homo sapiens
ttttctgcatgcggc

SEQ ID NO: 487096 - DNA, 15 bp, Homo sapiens
tttctgcatgcggcc

SEQ ID NO: 487097 - DNA, 15 bp, Homo sapiens
ttctgcatgcggccc

SEQ ID NO: 487098 - DNA, 15 bp, Homo sapiens
tctgcatgcggccct

SEQ ID NO: 487099 - DNA, 15 bp, Homo sapiens
ctgcatgcggccctt

SEQ ID NO: 487100 - DNA, 15 bp, Homo sapiens
tgcatgcggcccttc

SEQ ID NO: 487101 - DNA, 15 bp, Homo sapiens
gcatgcggcccttcg

SEQ ID NO: 487102 - DNA, 15 bp, Homo sapiens
catgcggcccttcgc

SEQ ID NO: 487103 - DNA, 15 bp, Homo sapiens
atgcggcccttcgcc

SEQ ID NO: 487104 - DNA, 15 bp, Homo sapiens
tgcggcccttcgcct

SEQ ID NO: 487105 - DNA, 15 bp, Homo sapiens
gcggcccttcgcctt

SEQ ID NO: 487106 - DNA, 15 bp, Homo sapiens
cggcccttcgccttc

SEQ ID NO: 487107 - DNA, 15 bp, Homo sapiens
ggcccttcgccttct

SEQ ID NO: 487108 - DNA, 15 bp, Homo sapiens
gcccttcgccttctt

SEQ ID NO: 487109 - DNA, 15 bp, Homo sapiens
cccttcgccttcttc

SEQ ID NO: 487110 - DNA, 15 bp, Homo sapiens
ccttcgccttcttcc

SEQ ID NO: 487111 - DNA, 15 bp, Homo sapiens
cttcgccttcttcct

SEQ ID NO: 487112 - DNA, 15 bp, Homo sapiens
ttcgccttcttcctt

SEQ ID NO: 487113 - DNA, 15 bp, Homo sapiens
tcgccttcttcctta

SEQ ID NO: 487114 - DNA, 15 bp, Homo sapiens
cgccttcttccttaa

SEQ ID NO: 487115 - DNA, 15 bp, Homo sapiens
gccttcttccttaag

SEQ ID NO: 487116 - DNA, 15 bp, Homo sapiens
ccttcttccttaaga

SEQ ID NO: 487117 - DNA, 15 bp, Homo sapiens
cttcttccttaagat

SEQ ID NO: 487118 - DNA, 15 bp, Homo sapiens
ttcttccttaagata

SEQ ID NO: 487119 - DNA, 15 bp, Homo sapiens
tcttccttaagataa

SEQ ID NO: 487120 - DNA, 15 bp, Homo sapiens
cttccttaagataac

SEQ ID NO: 487121 - DNA, 15 bp, Homo sapiens
ttccttaagataaca

SEQ ID NO: 487122 - DNA, 15 bp, Homo sapiens
tccttaagataacaa

SEQ ID NO: 487123 - DNA, 15 bp, Homo sapiens
ccttaagataacaaa

SEQ ID NO: 487124 - DNA, 15 bp, Homo sapiens
cttaagataacaaaa

SEQ ID NO: 487125 - DNA, 15 bp, Homo sapiens
ttaagataacaaaaa

SEQ ID NO: 487126 - DNA, 15 bp, Homo sapiens
taagataacaaaaac

SEQ ID NO: 487127 - DNA, 15 bp, Homo sapiens
aagataacaaaaacc

SEQ ID NO: 487128 - DNA, 15 bp, Homo sapiens
agataacaaaaacct

SEQ ID NO: 487129 - DNA, 15 bp, Homo sapiens
gataacaaaaacctt

SEQ ID NO: 487130 - DNA, 15 bp, Homo sapiens
ataacaaaaacctta

SEQ ID NO: 487131 - DNA, 15 bp, Homo sapiens
taacaaaaaccttat

SEQ ID NO: 487132 - DNA, 15 bp, Homo sapiens
aacaaaaaccttatt

SEQ ID NO: 487133 - DNA, 15 bp, Homo sapiens
acaaaaaccttatta

SEQ ID NO: 487134 - DNA, 15 bp, Homo sapiens
caaaaaccttattac

SEQ ID NO: 487135 - DNA, 15 bp, Homo sapiens
aaaaaccttattaca

SEQ ID NO: 487136 - DNA, 15 bp, Homo sapiens
aaaaccttattacaa

SEQ ID NO: 487137 - DNA, 15 bp, Homo sapiens
aaaccttattacaaa

SEQ ID NO: 487138 - DNA, 15 bp, Homo sapiens
aaccttattacaaac

SEQ ID NO: 487139 - DNA, 15 bp, Homo sapiens
accttattacaaaca

SEQ ID NO: 487140 - DNA, 15 bp, Homo sapiens
ccttattacaaacag

SEQ ID NO: 487141 - DNA, 15 bp, Homo sapiens
cttattacaaacagg

SEQ ID NO: 487142 - DNA, 15 bp, Homo sapiens
ttattacaaacagga

SEQ ID NO: 487143 - DNA, 15 bp, Homo sapiens
tattacaaacaggac

SEQ ID NO: 487144 - DNA, 15 bp, Homo sapiens
attacaaacaggact

SEQ ID NO: 487145 - DNA, 15 bp, Homo sapiens
ttacaaacaggactg

SEQ ID NO: 487146 - DNA, 15 bp, Homo sapiens
tacaaacaggactga

SEQ ID NO: 487147 - DNA, 15 bp, Homo sapiens
acaaacaggactgaa

SEQ ID NO: 487148 - DNA, 15 bp, Homo sapiens
caaacaggactgaat

SEQ ID NO: 487149 - DNA, 15 bp, Homo sapiens
aaacaggactgaata

SEQ ID NO: 487150 - DNA, 15 bp, Homo sapiens
aacaggactgaatat

SEQ ID NO: 487151 - DNA, 15 bp, Homo sapiens
acaggactgaatatt

SEQ ID NO: 487152 - DNA, 15 bp, Homo sapiens
caggactgaatatta

SEQ ID NO: 487153 - DNA, 15 bp, Homo sapiens
aggactgaatattat

SEQ ID NO: 487154 - DNA, 15 bp, Homo sapiens
ggactgaatattatt

SEQ ID NO: 487155 - DNA, 15 bp, Homo sapiens
gactgaatattattt

SEQ ID NO: 487156 - DNA, 15 bp, Homo sapiens
actgaatattatttg

SEQ ID NO: 487157 - DNA, 15 bp, Homo sapiens
ctgaatattatttga

SEQ ID NO: 487158 - DNA, 15 bp, Homo sapiens
tgaatattatttgaa

SEQ ID NO: 487159 - DNA, 15 bp, Homo sapiens
gaatattatttgaaa

SEQ ID NO: 487160 - DNA, 15 bp, Homo sapiens
aatattatttgaaaa

SEQ ID NO: 487161 - DNA, 15 bp, Homo sapiens
atattatttgaaaat

SEQ ID NO: 487162 - DNA, 15 bp, Homo sapiens
tattatttgaaaata

SEQ ID NO: 487163 - DNA, 15 bp, Homo sapiens
attatttgaaaataa

SEQ ID NO: 487164 - DNA, 15 bp, Homo sapiens
ttatttgaaaataag

SEQ ID NO: 487165 - DNA, 15 bp, Homo sapiens
tatttgaaaataagg

SEQ ID NO: 487166 - DNA, 15 bp, Homo sapiens
atttgaaaataaggc

SEQ ID NO: 487167 - DNA, 15 bp, Homo sapiens
tttgaaaataaggca

SEQ ID NO: 487168 - DNA, 15 bp, Homo sapiens
ttgaaaataaggcaa

SEQ ID NO: 487169 - DNA, 15 bp, Homo sapiens
tgaaaataaggcaaa

SEQ ID NO: 487170 - DNA, 15 bp, Homo sapiens
gaaaataaggcaaac

SEQ ID NO: 487171 - DNA, 15 bp, Homo sapiens
aaaataaggcaaaca

SEQ ID NO: 487172 - DNA, 15 bp, Homo sapiens
aaataaggcaaacat

SEQ ID NO: 487173 - DNA, 15 bp, Homo sapiens
aataaggcaaacatt

SEQ ID NO: 487174 - DNA, 15 bp, Homo sapiens
ataaggcaaacatta

SEQ ID NO: 487175 - DNA, 15 bp, Homo sapiens
taaggcaaacattat

SEQ ID NO: 487176 - DNA, 15 bp, Homo sapiens
aaggcaaacattata

SEQ ID NO: 487177 - DNA, 15 bp, Homo sapiens
aggcaaacattatat

SEQ ID NO: 487178 - DNA, 15 bp, Homo sapiens
ggcaaacattatata

SEQ ID NO: 487179 - DNA, 15 bp, Homo sapiens
gcaaacattatataa

SEQ ID NO: 487180 - DNA, 15 bp, Homo sapiens
caaacattatataag

SEQ ID NO: 487181 - DNA, 15 bp, Homo sapiens
aaacattatataaga

SEQ ID NO: 487182 - DNA, 15 bp, Homo sapiens
aacattatataagaa

SEQ ID NO: 487183 - DNA, 15 bp, Homo sapiens
acattatataagaaa

SEQ ID NO: 487184 - DNA, 15 bp, Homo sapiens
cattatataagaaaa

SEQ ID NO: 487185 - DNA, 15 bp, Homo sapiens
attatataagaaaat

SEQ ID NO: 487186 - DNA, 15 bp, Homo sapiens
ttatataagaaaatg

SEQ ID NO: 487187 - DNA, 15 bp, Homo sapiens
tatataagaaaatga

SEQ ID NO: 487188 - DNA, 15 bp, Homo sapiens
atataagaaaatgaa

SEQ ID NO: 487189 - DNA, 15 bp, Homo sapiens
tataagaaaatgaag

SEQ ID NO: 487190 - DNA, 15 bp, Homo sapiens
ataagaaaatgaagc

SEQ ID NO: 487191 - DNA, 15 bp, Homo sapiens
taagaaaatgaagct

SEQ ID NO: 487192 - DNA, 15 bp, Homo sapiens
aagaaaatgaagctc

SEQ ID NO: 487193 - DNA, 15 bp, Homo sapiens
agaaaatgaagctca

SEQ ID NO: 487194 - DNA, 15 bp, Homo sapiens
gaaaatgaagctcaa

SEQ ID NO: 487195 - DNA, 15 bp, Homo sapiens
aaaatgaagctcaac

SEQ ID NO: 487196 - DNA, 15 bp, Homo sapiens
aaatgaagctcaacc

SEQ ID NO: 487197 - DNA, 15 bp, Homo sapiens
aatgaagctcaacct

SEQ ID NO: 487198 - DNA, 15 bp, Homo sapiens
atgaagctcaaccta

SEQ ID NO: 487199 - DNA, 15 bp, Homo sapiens
tgaagctcaacctag

SEQ ID NO: 487200 - DNA, 15 bp, Homo sapiens
gaagctcaacctaga

SEQ ID NO: 487201 - DNA, 15 bp, Homo sapiens
aagctcaacctagat

SEQ ID NO: 487202 - DNA, 15 bp, Homo sapiens
agctcaacctagata

SEQ ID NO: 487203 - DNA, 15 bp, Homo sapiens
gctcaacctagatac

SEQ ID NO: 487204 - DNA, 15 bp, Homo sapiens
ctcaacctagatact

SEQ ID NO: 487205 - DNA, 15 bp, Homo sapiens
tcaacctagatacta

SEQ ID NO: 487206 - DNA, 15 bp, Homo sapiens
caacctagatactat

SEQ ID NO: 487207 - DNA, 15 bp, Homo sapiens
aacctagatactatc

SEQ ID NO: 487208 - DNA, 15 bp, Homo sapiens
acctagatactatca

SEQ ID NO: 487209 - DNA, 15 bp, Homo sapiens
cctagatactatcaa

SEQ ID NO: 487210 - DNA, 15 bp, Homo sapiens
ctagatactatcaag

SEQ ID NO: 487211 - DNA, 15 bp, Homo sapiens
tagatactatcaagt

SEQ ID NO: 487212 - DNA, 15 bp, Homo sapiens
agatactatcaagta

SEQ ID NO: 487213 - DNA, 15 bp, Homo sapiens
gatactatcaagtaa

SEQ ID NO: 487214 - DNA, 15 bp, Homo sapiens
atactatcaagtaac

SEQ ID NO: 487215 - DNA, 15 bp, Homo sapiens
tactatcaagtaacg

SEQ ID NO: 487216 - DNA, 15 bp, Homo sapiens
actatcaagtaacgg

SEQ ID NO: 487217 - DNA, 15 bp, Homo sapiens
ctatcaagtaacggg

SEQ ID NO: 487218 - DNA, 15 bp, Homo sapiens
tatcaagtaacgggg

SEQ ID NO: 487219 - DNA, 15 bp, Homo sapiens
atcaagtaacggggg

SEQ ID NO: 487220 - DNA, 15 bp, Homo sapiens
tcaagtaacgggggt

SEQ ID NO: 487221 - DNA, 15 bp, Homo sapiens
caagtaacgggggta

SEQ ID NO: 487222 - DNA, 15 bp, Homo sapiens
aagtaacgggggtac

SEQ ID NO: 487223 - DNA, 15 bp, Homo sapiens
agtaacgggggtaca

SEQ ID NO: 487224 - DNA, 15 bp, Homo sapiens
gtaacgggggtacag

SEQ ID NO: 487225 - DNA, 15 bp, Homo sapiens
taacgggggtacagt

SEQ ID NO: 487226 - DNA, 15 bp, Homo sapiens
aacgggggtacagtc

SEQ ID NO: 487227 - DNA, 15 bp, Homo sapiens
acgggggtacagtcg

SEQ ID NO: 487228 - DNA, 15 bp, Homo sapiens
cgggggtacagtcgc

SEQ ID NO: 487229 - DNA, 15 bp, Homo sapiens
gggggtacagtcgca

SEQ ID NO: 487230 - DNA, 15 bp, Homo sapiens
ggggtacagtcgcaa

SEQ ID NO: 487231 - DNA, 15 bp, Homo sapiens
gggtacagtcgcaac

SEQ ID NO: 487232 - DNA, 15 bp, Homo sapiens
ggtacagtcgcaacg

SEQ ID NO: 487233 - DNA, 15 bp, Homo sapiens
gtacagtcgcaacgc

SEQ ID NO: 487234 - DNA, 15 bp, Homo sapiens
tacagtcgcaacgca

SEQ ID NO: 487235 - DNA, 15 bp, Homo sapiens
acagtcgcaacgcaa

SEQ ID NO: 487236 - DNA, 15 bp, Homo sapiens
cagtcgcaacgcaat

SEQ ID NO: 487237 - DNA, 15 bp, Homo sapiens
agtcgcaacgcaatt

SEQ ID NO: 487238 - DNA, 15 bp, Homo sapiens
gtcgcaacgcaattc

SEQ ID NO: 487239 - DNA, 15 bp, Homo sapiens
tcgcaacgcaattct

SEQ ID NO: 487240 - DNA, 15 bp, Homo sapiens
cgcaacgcaattctg

SEQ ID NO: 487241 - DNA, 15 bp, Homo sapiens
gcaacgcaattctgc

SEQ ID NO: 487242 - DNA, 15 bp, Homo sapiens
caacgcaattctgct

SEQ ID NO: 487243 - DNA, 15 bp, Homo sapiens
aacgcaattctgctc

SEQ ID NO: 487244 - DNA, 15 bp, Homo sapiens
acgcaattctgctct

SEQ ID NO: 487245 - DNA, 15 bp, Homo sapiens
cgcaattctgctctt

SEQ ID NO: 487246 - DNA, 15 bp, Homo sapiens
gcaattctgctcttt

SEQ ID NO: 487247 - DNA, 15 bp, Homo sapiens
caattctgctctttg

SEQ ID NO: 487248 - DNA, 15 bp, Homo sapiens
aattctgctctttga

SEQ ID NO: 487249 - DNA, 15 bp, Homo sapiens
attctgctctttgag

SEQ ID NO: 487250 - DNA, 15 bp, Homo sapiens
ttctgctctttgaga

SEQ ID NO: 487251 - DNA, 15 bp, Homo sapiens
tctgctctttgagat

SEQ ID NO: 487252 - DNA, 15 bp, Homo sapiens
ctgctctttgagatt

SEQ ID NO: 487253 - DNA, 15 bp, Homo sapiens
tgctctttgagattt

SEQ ID NO: 487254 - DNA, 15 bp, Homo sapiens
gctctttgagatttt

SEQ ID NO: 487255 - DNA, 15 bp, Homo sapiens
ctctttgagattttt

SEQ ID NO: 487256 - DNA, 15 bp, Homo sapiens
tctttgagatttttc

SEQ ID NO: 487257 - DNA, 15 bp, Homo sapiens
ctttgagatttttca

SEQ ID NO: 487258 - DNA, 15 bp, Homo sapiens
tttgagatttttcaa

SEQ ID NO: 487259 - DNA, 15 bp, Homo sapiens
ttgagatttttcaat

SEQ ID NO: 487260 - DNA, 15 bp, Homo sapiens
tgagatttttcaata

SEQ ID NO: 487261 - DNA, 15 bp, Homo sapiens
gagatttttcaatat

SEQ ID NO: 487262 - DNA, 15 bp, Homo sapiens
agatttttcaatatg

SEQ ID NO: 487263 - DNA, 15 bp, Homo sapiens
gatttttcaatatgc

SEQ ID NO: 487264 - DNA, 15 bp, Homo sapiens
atttttcaatatgcc

SEQ ID NO: 487265 - DNA, 15 bp, Homo sapiens
tttttcaatatgcct

SEQ ID NO: 487266 - DNA, 15 bp, Homo sapiens
ttttcaatatgcctg

SEQ ID NO: 487267 - DNA, 15 bp, Homo sapiens
tttcaatatgcctga

SEQ ID NO: 487268 - DNA, 15 bp, Homo sapiens
ttcaatatgcctgat

SEQ ID NO: 487269 - DNA, 15 bp, Homo sapiens
tcaatatgcctgatg

SEQ ID NO: 487270 - DNA, 15 bp, Homo sapiens
caatatgcctgatgg

SEQ ID NO: 487271 - DNA, 15 bp, Homo sapiens
aatatgcctgatggg

SEQ ID NO: 487272 - DNA, 15 bp, Homo sapiens
atatgcctgatgggt

SEQ ID NO: 487273 - DNA, 15 bp, Homo sapiens
tatgcctgatgggtg

SEQ ID NO: 487274 - DNA, 15 bp, Homo sapiens
atgcctgatgggtga

SEQ ID NO: 487275 - DNA, 15 bp, Homo sapiens
tgcctgatgggtgat

SEQ ID NO: 487276 - DNA, 15 bp, Homo sapiens
gcctgatgggtgata

SEQ ID NO: 487277 - DNA, 15 bp, Homo sapiens
cctgatgggtgataa

SEQ ID NO: 487278 - DNA, 15 bp, Homo sapiens
ctgatgggtgataaa

SEQ ID NO: 487279 - DNA, 15 bp, Homo sapiens
tgatgggtgataaaa

SEQ ID NO: 487280 - DNA, 15 bp, Homo sapiens
gatgggtgataaaat

SEQ ID NO: 487281 - DNA, 15 bp, Homo sapiens
atgggtgataaaatg

SEQ ID NO: 487282 - DNA, 15 bp, Homo sapiens
tgggtgataaaatga

SEQ ID NO: 487283 - DNA, 15 bp, Homo sapiens
gggtgataaaatgaa

SEQ ID NO: 487284 - DNA, 15 bp, Homo sapiens
ggtgataaaatgaaa

SEQ ID NO: 487285 - DNA, 15 bp, Homo sapiens
gtgataaaatgaaag

SEQ ID NO: 487286 - DNA, 15 bp, Homo sapiens
tgataaaatgaaagc

SEQ ID NO: 487287 - DNA, 15 bp, Homo sapiens
gataaaatgaaagca

SEQ ID NO: 487288 - DNA, 15 bp, Homo sapiens
ataaaatgaaagcaa

SEQ ID NO: 487289 - DNA, 15 bp, Homo sapiens
taaaatgaaagcaaa

SEQ ID NO: 487290 - DNA, 15 bp, Homo sapiens
aaaatgaaagcaaat

SEQ ID NO: 487291 - DNA, 15 bp, Homo sapiens
aaatgaaagcaaata

SEQ ID NO: 487292 - DNA, 15 bp, Homo sapiens
aatgaaagcaaataa

SEQ ID NO: 487293 - DNA, 15 bp, Homo sapiens
atgaaagcaaataaa

SEQ ID NO: 487294 - DNA, 15 bp, Homo sapiens
tgaaagcaaataaaa

SEQ ID NO: 487295 - DNA, 15 bp, Homo sapiens
gaaagcaaataaaat

SEQ ID NO: 487296 - DNA, 15 bp, Homo sapiens
aaagcaaataaaata

SEQ ID NO: 487297 - DNA, 15 bp, Homo sapiens
aagcaaataaaataa

SEQ ID NO: 487298 - DNA, 15 bp, Homo sapiens
agcaaataaaataat

SEQ ID NO: 487299 - DNA, 15 bp, Homo sapiens
gcaaataaaataata

SEQ ID NO: 487300 - DNA, 15 bp, Homo sapiens
caaataaaataataa

SEQ ID NO: 487301 - DNA, 15 bp, Homo sapiens
aaataaaataataag

SEQ ID NO: 487302 - DNA, 15 bp, Homo sapiens
aataaaataataagt

SEQ ID NO: 487303 - DNA, 15 bp, Homo sapiens
ataaaataataagtc

SEQ ID NO: 487304 - DNA, 15 bp, Homo sapiens
taaaataataagtct

SEQ ID NO: 487305 - DNA, 15 bp, Homo sapiens
aaaataataagtctg

SEQ ID NO: 487306 - DNA, 15 bp, Homo sapiens
aaataataagtctgg

SEQ ID NO: 487307 - DNA, 15 bp, Homo sapiens
aataataagtctggt

SEQ ID NO: 487308 - DNA, 15 bp, Homo sapiens
ataataagtctggtt

SEQ ID NO: 487309 - DNA, 15 bp, Homo sapiens
taataagtctggttt

SEQ ID NO: 487310 - DNA, 15 bp, Homo sapiens
aataagtctggtttt

SEQ ID NO: 487311 - DNA, 15 bp, Homo sapiens
ataagtctggtttta

SEQ ID NO: 487312 - DNA, 15 bp, Homo sapiens
taagtctggttttaa

SEQ ID NO: 487313 - DNA, 15 bp, Homo sapiens
aagtctggttttaag

SEQ ID NO: 487314 - DNA, 15 bp, Homo sapiens
agtctggttttaaga

SEQ ID NO: 487315 - DNA, 15 bp, Homo sapiens
gtctggttttaagaa

SEQ ID NO: 487316 - DNA, 15 bp, Homo sapiens
tctggttttaagaag

SEQ ID NO: 487317 - DNA, 15 bp, Homo sapiens
ctggttttaagaaga

SEQ ID NO: 487318 - DNA, 15 bp, Homo sapiens
tggttttaagaagaa

SEQ ID NO: 487319 - DNA, 15 bp, Homo sapiens
ggttttaagaagaaa

SEQ ID NO: 487320 - DNA, 15 bp, Homo sapiens
gttttaagaagaaat

SEQ ID NO: 487321 - DNA, 15 bp, Homo sapiens
ttttaagaagaaatt

SEQ ID NO: 487322 - DNA, 15 bp, Homo sapiens
tttaagaagaaatta

SEQ ID NO: 487323 - DNA, 15 bp, Homo sapiens
ttaagaagaaattat

SEQ ID NO: 487324 - DNA, 15 bp, Homo sapiens
taagaagaaattatc

SEQ ID NO: 487325 - DNA, 15 bp, Homo sapiens
aagaagaaattatcc

SEQ ID NO: 487326 - DNA, 15 bp, Homo sapiens
agaagaaattatcct

SEQ ID NO: 487327 - DNA, 15 bp, Homo sapiens
gaagaaattatcctc

SEQ ID NO: 487328 - DNA, 15 bp, Homo sapiens
aagaaattatcctct

SEQ ID NO: 487329 - DNA, 15 bp, Homo sapiens
agaaattatcctctt

SEQ ID NO: 487330 - DNA, 15 bp, Homo sapiens
gaaattatcctcttc

SEQ ID NO: 487331 - DNA, 15 bp, Homo sapiens
aaattatcctcttcg

SEQ ID NO: 487332 - DNA, 15 bp, Homo sapiens
aattatcctcttcga

SEQ ID NO: 487333 - DNA, 15 bp, Homo sapiens
attatcctcttcgat

SEQ ID NO: 487334 - DNA, 15 bp, Homo sapiens
ttatcctcttcgatg

SEQ ID NO: 487335 - DNA, 15 bp, Homo sapiens
tatcctcttcgatgc

SEQ ID NO: 487336 - DNA, 15 bp, Homo sapiens
atcctcttcgatgca

SEQ ID NO: 487337 - DNA, 15 bp, Homo sapiens
tcctcttcgatgcaa

SEQ ID NO: 487338 - DNA, 15 bp, Homo sapiens
cctcttcgatgcaag

SEQ ID NO: 487339 - DNA, 15 bp, Homo sapiens
ctcttcgatgcaagc

SEQ ID NO: 487340 - DNA, 15 bp, Homo sapiens
tcttcgatgcaagct

SEQ ID NO: 487341 - DNA, 15 bp, Homo sapiens
cttcgatgcaagcta

SEQ ID NO: 487342 - DNA, 15 bp, Homo sapiens
ttcgatgcaagctat

SEQ ID NO: 487343 - DNA, 15 bp, Homo sapiens
tcgatgcaagctatc

SEQ ID NO: 487344 - DNA, 15 bp, Homo sapiens
cgatgcaagctatca

SEQ ID NO: 487345 - DNA, 15 bp, Homo sapiens
gatgcaagctatcat

SEQ ID NO: 487346 - DNA, 15 bp, Homo sapiens
atgcaagctatcata

SEQ ID NO: 487347 - DNA, 15 bp, Homo sapiens
tgcaagctatcataa

SEQ ID NO: 487348 - DNA, 15 bp, Homo sapiens
gcaagctatcataag

SEQ ID NO: 487349 - DNA, 15 bp, Homo sapiens
caagctatcataagg

SEQ ID NO: 487350 - DNA, 15 bp, Homo sapiens
aagctatcataagga

SEQ ID NO: 487351 - DNA, 15 bp, Homo sapiens
agctatcataaggaa

SEQ ID NO: 487352 - DNA, 15 bp, Homo sapiens
gctatcataaggaac

SEQ ID NO: 487353 - DNA, 15 bp, Homo sapiens
ctatcataaggaaca

SEQ ID NO: 487354 - DNA, 15 bp, Homo sapiens
tatcataaggaacac

SEQ ID NO: 487355 - DNA, 15 bp, Homo sapiens
atcataaggaacaca

SEQ ID NO: 487356 - DNA, 15 bp, Homo sapiens
tcataaggaacacat

SEQ ID NO: 487357 - DNA, 15 bp, Homo sapiens
cataaggaacacatc

SEQ ID NO: 487358 - DNA, 15 bp, Homo sapiens
ataaggaacacatct

SEQ ID NO: 487359 - DNA, 15 bp, Homo sapiens
taaggaacacatctt

SEQ ID NO: 487360 - DNA, 15 bp, Homo sapiens
aaggaacacatctta

SEQ ID NO: 487361 - DNA, 15 bp, Homo sapiens
aggaacacatcttag

SEQ ID NO: 487362 - DNA, 15 bp, Homo sapiens
ggaacacatcttagt

SEQ ID NO: 487363 - DNA, 15 bp, Homo sapiens
gaacacatcttagtt

SEQ ID NO: 487364 - DNA, 15 bp, Homo sapiens
aacacatcttagttc

SEQ ID NO: 487365 - DNA, 15 bp, Homo sapiens
acacatcttagttca

SEQ ID NO: 487366 - DNA, 15 bp, Homo sapiens
cacatcttagttcaa

SEQ ID NO: 487367 - DNA, 15 bp, Homo sapiens
acatcttagttcaaa

SEQ ID NO: 487368 - DNA, 15 bp, Homo sapiens
catcttagttcaaag

SEQ ID NO: 487369 - DNA, 15 bp, Homo sapiens
atcttagttcaaaga

SEQ ID NO: 487370 - DNA, 15 bp, Homo sapiens
tcttagttcaaagaa

SEQ ID NO: 487371 - DNA, 15 bp, Homo sapiens
cttagttcaaagaag

SEQ ID NO: 487372 - DNA, 15 bp, Homo sapiens
ttagttcaaagaaga

SEQ ID NO: 487373 - DNA, 15 bp, Homo sapiens
tagttcaaagaagag

SEQ ID NO: 487374 - DNA, 15 bp, Homo sapiens
agttcaaagaagagc

SEQ ID NO: 487375 - DNA, 15 bp, Homo sapiens
gttcaaagaagagct

SEQ ID NO: 487376 - DNA, 15 bp, Homo sapiens
ttcaaagaagagctt

SEQ ID NO: 487377 - DNA, 15 bp, Homo sapiens
tcaaagaagagcttt

SEQ ID NO: 487378 - DNA, 15 bp, Homo sapiens
caaagaagagctttc

SEQ ID NO: 487379 - DNA, 15 bp, Homo sapiens
aaagaagagctttca

SEQ ID NO: 487380 - DNA, 15 bp, Homo sapiens
aagaagagctttcag

SEQ ID NO: 487381 - DNA, 15 bp, Homo sapiens
agaagagctttcagt

SEQ ID NO: 487382 - DNA, 15 bp, Homo sapiens
gaagagctttcagtg

SEQ ID NO: 487383 - DNA, 15 bp, Homo sapiens
aagagctttcagtgg

SEQ ID NO: 487384 - DNA, 15 bp, Homo sapiens
agagctttcagtggc

SEQ ID NO: 487385 - DNA, 15 bp, Homo sapiens
gagctttcagtggca

SEQ ID NO: 487386 - DNA, 15 bp, Homo sapiens
agctttcagtggcat

SEQ ID NO: 487387 - DNA, 15 bp, Homo sapiens
gctttcagtggcatg

SEQ ID NO: 487388 - DNA, 15 bp, Homo sapiens
ctttcagtggcatgc

SEQ ID NO: 487389 - DNA, 15 bp, Homo sapiens
tttcagtggcatgcc

SEQ ID NO: 487390 - DNA, 15 bp, Homo sapiens
ttcagtggcatgcca

SEQ ID NO: 487391 - DNA, 15 bp, Homo sapiens
tcagtggcatgccaa

SEQ ID NO: 487392 - DNA, 15 bp, Homo sapiens
cagtggcatgccaaa

SEQ ID NO: 487393 - DNA, 15 bp, Homo sapiens
agtggcatgccaaac

SEQ ID NO: 487394 - DNA, 15 bp, Homo sapiens
gtggcatgccaaaca

SEQ ID NO: 487395 - DNA, 15 bp, Homo sapiens
tggcatgccaaacaa

SEQ ID NO: 487396 - DNA, 15 bp, Homo sapiens
ggcatgccaaacaag

SEQ ID NO: 487397 - DNA, 15 bp, Homo sapiens
gcatgccaaacaagg

SEQ ID NO: 487398 - DNA, 15 bp, Homo sapiens
catgccaaacaaggc

SEQ ID NO: 487399 - DNA, 15 bp, Homo sapiens
atgccaaacaaggca

SEQ ID NO: 487400 - DNA, 15 bp, Homo sapiens
tgccaaacaaggcat

SEQ ID NO: 487401 - DNA, 15 bp, Homo sapiens
gccaaacaaggcatg

SEQ ID NO: 487402 - DNA, 15 bp, Homo sapiens
ccaaacaaggcatgg

SEQ ID NO: 487403 - DNA, 15 bp, Homo sapiens
caaacaaggcatgga

SEQ ID NO: 487404 - DNA, 15 bp, Homo sapiens
aaacaaggcatggaa

SEQ ID NO: 487405 - DNA, 15 bp, Homo sapiens
aacaaggcatggaaa

SEQ ID NO: 487406 - DNA, 15 bp, Homo sapiens
acaaggcatggaaac

SEQ ID NO: 487407 - DNA, 15 bp, Homo sapiens
caaggcatggaaaca

SEQ ID NO: 487408 - DNA, 15 bp, Homo sapiens
aaggcatggaaacag

SEQ ID NO: 487409 - DNA, 15 bp, Homo sapiens
aggcatggaaacagc

SEQ ID NO: 487410 - DNA, 15 bp, Homo sapiens
ggcatggaaacagcc

SEQ ID NO: 487411 - DNA, 15 bp, Homo sapiens
gcatggaaacagcct

SEQ ID NO: 487412 - DNA, 15 bp, Homo sapiens
catggaaacagcctt

SEQ ID NO: 487413 - DNA, 15 bp, Homo sapiens
atggaaacagccttt

SEQ ID NO: 487414 - DNA, 15 bp, Homo sapiens
tggaaacagcctttc

SEQ ID NO: 487415 - DNA, 15 bp, Homo sapiens
ggaaacagcctttct

SEQ ID NO: 487416 - DNA, 15 bp, Homo sapiens
gaaacagcctttcta

SEQ ID NO: 487417 - DNA, 15 bp, Homo sapiens
aaacagcctttctag

SEQ ID NO: 487418 - DNA, 15 bp, Homo sapiens
aacagcctttctagt

SEQ ID NO: 487419 - DNA, 15 bp, Homo sapiens
acagcctttctagtg

SEQ ID NO: 487420 - DNA, 15 bp, Homo sapiens
cagcctttctagtgt

SEQ ID NO: 487421 - DNA, 15 bp, Homo sapiens
agcctttctagtgta

SEQ ID NO: 487422 - DNA, 15 bp, Homo sapiens
gcctttctagtgtaa

SEQ ID NO: 487423 - DNA, 15 bp, Homo sapiens
cctttctagtgtaat

SEQ ID NO: 487424 - DNA, 15 bp, Homo sapiens
ctttctagtgtaatt

SEQ ID NO: 487425 - DNA, 15 bp, Homo sapiens
tttctagtgtaattc

SEQ ID NO: 487426 - DNA, 15 bp, Homo sapiens
ttctagtgtaattcc

SEQ ID NO: 487427 - DNA, 15 bp, Homo sapiens
tctagtgtaattccc

SEQ ID NO: 487428 - DNA, 15 bp, Homo sapiens
ctagtgtaattccct

SEQ ID NO: 487429 - DNA, 15 bp, Homo sapiens
tagtgtaattccctc

SEQ ID NO: 487430 - DNA, 15 bp, Homo sapiens
agtgtaattccctct

SEQ ID NO: 487431 - DNA, 15 bp, Homo sapiens
gtgtaattccctctc

SEQ ID NO: 487432 - DNA, 15 bp, Homo sapiens
tgtaattccctctct

SEQ ID NO: 487433 - DNA, 15 bp, Homo sapiens
gtaattccctctctt

SEQ ID NO: 487434 - DNA, 15 bp, Homo sapiens
taattccctctcttt

SEQ ID NO: 487435 - DNA, 15 bp, Homo sapiens
aattccctctctttt

SEQ ID NO: 487436 - DNA, 15 bp, Homo sapiens
attccctctcttttc

SEQ ID NO: 487437 - DNA, 15 bp, Homo sapiens
ttccctctcttttct

SEQ ID NO: 487438 - DNA, 15 bp, Homo sapiens
tccctctcttttctt

SEQ ID NO: 487439 - DNA, 15 bp, Homo sapiens
ccctctcttttcttc

SEQ ID NO: 487440 - DNA, 15 bp, Homo sapiens
cctctcttttcttca

SEQ ID NO: 487441 - DNA, 15 bp, Homo sapiens
ctctcttttcttcaa

SEQ ID NO: 487442 - DNA, 15 bp, Homo sapiens
ctcttttcttcaaac

SEQ ID NO: 487443 - DNA, 15 bp, Homo sapiens
tcttttcttcaaaca

SEQ ID NO: 487444 - DNA, 15 bp, Homo sapiens
cttttcttcaaacat

SEQ ID NO: 487445 - DNA, 15 bp, Homo sapiens
ttttcttcaaacatt

SEQ ID NO: 487446 - DNA, 15 bp, Homo sapiens
tttcttcaaacattg

SEQ ID NO: 487447 - DNA, 15 bp, Homo sapiens
ttcttcaaacattgt

SEQ ID NO: 487448 - DNA, 15 bp, Homo sapiens
tcttcaaacattgtt

SEQ ID NO: 487449 - DNA, 15 bp, Homo sapiens
cttcaaacattgttc

SEQ ID NO: 487450 - DNA, 15 bp, Homo sapiens
ttcaaacattgttct

SEQ ID NO: 487451 - DNA, 15 bp, Homo sapiens
tcaaacattgttctc

SEQ ID NO: 487452 - DNA, 15 bp, Homo sapiens
caaacattgttctcc

SEQ ID NO: 487453 - DNA, 15 bp, Homo sapiens
aaacattgttctcca

SEQ ID NO: 487454 - DNA, 15 bp, Homo sapiens
aacattgttctccaa

SEQ ID NO: 487455 - DNA, 15 bp, Homo sapiens
acattgttctccaat

SEQ ID NO: 487456 - DNA, 15 bp, Homo sapiens
cattgttctccaatg

SEQ ID NO: 487457 - DNA, 15 bp, Homo sapiens
attgttctccaatgt

SEQ ID NO: 487458 - DNA, 15 bp, Homo sapiens
ttgttctccaatgtc

SEQ ID NO: 487459 - DNA, 15 bp, Homo sapiens
tgttctccaatgtca

SEQ ID NO: 487460 - DNA, 15 bp, Homo sapiens
gttctccaatgtcat

SEQ ID NO: 487461 - DNA, 15 bp, Homo sapiens
ttctccaatgtcatc

SEQ ID NO: 487462 - DNA, 15 bp, Homo sapiens
tctccaatgtcatca

SEQ ID NO: 487463 - DNA, 15 bp, Homo sapiens
ctccaatgtcatcag

SEQ ID NO: 487464 - DNA, 15 bp, Homo sapiens
tccaatgtcatcaga

SEQ ID NO: 487465 - DNA, 15 bp, Homo sapiens
ccaatgtcatcagac

SEQ ID NO: 487466 - DNA, 15 bp, Homo sapiens
caatgtcatcagact

SEQ ID NO: 487467 - DNA, 15 bp, Homo sapiens
aatgtcatcagactc

SEQ ID NO: 487468 - DNA, 15 bp, Homo sapiens
atgtcatcagactcc

SEQ ID NO: 487469 - DNA, 15 bp, Homo sapiens
tgtcatcagactcca

SEQ ID NO: 487470 - DNA, 15 bp, Homo sapiens
gtcatcagactccag

SEQ ID NO: 487471 - DNA, 15 bp, Homo sapiens
tcatcagactccagt

SEQ ID NO: 487472 - DNA, 15 bp, Homo sapiens
catcagactccagtg

SEQ ID NO: 487473 - DNA, 15 bp, Homo sapiens
atcagactccagtgc

SEQ ID NO: 487474 - DNA, 15 bp, Homo sapiens
tcagactccagtgca

SEQ ID NO: 487475 - DNA, 15 bp, Homo sapiens
cagactccagtgcag

SEQ ID NO: 487476 - DNA, 15 bp, Homo sapiens
agactccagtgcaga

SEQ ID NO: 487477 - DNA, 15 bp, Homo sapiens
gactccagtgcagaa

SEQ ID NO: 487478 - DNA, 15 bp, Homo sapiens
actccagtgcagaaa

SEQ ID NO: 487479 - DNA, 15 bp, Homo sapiens
ctccagtgcagaaag

SEQ ID NO: 487480 - DNA, 15 bp, Homo sapiens
tccagtgcagaaagg

SEQ ID NO: 487481 - DNA, 15 bp, Homo sapiens
ccagtgcagaaaggg

SEQ ID NO: 487482 - DNA, 15 bp, Homo sapiens
cagtgcagaaaggga

SEQ ID NO: 487483 - DNA, 15 bp, Homo sapiens
agtgcagaaagggat

SEQ ID NO: 487484 - DNA, 15 bp, Homo sapiens
gtgcagaaagggatt

SEQ ID NO: 487485 - DNA, 15 bp, Homo sapiens
tgcagaaagggattg

SEQ ID NO: 487486 - DNA, 15 bp, Homo sapiens
gcagaaagggattgt

SEQ ID NO: 487487 - DNA, 15 bp, Homo sapiens
cagaaagggattgtt

SEQ ID NO: 487488 - DNA, 15 bp, Homo sapiens
agaaagggattgttt

SEQ ID NO: 487489 - DNA, 15 bp, Homo sapiens
gaaagggattgtttt

SEQ ID NO: 487490 - DNA, 15 bp, Homo sapiens
aaagggattgttttc

SEQ ID NO: 487491 - DNA, 15 bp, Homo sapiens
aagggattgttttca

SEQ ID NO: 487492 - DNA, 15 bp, Homo sapiens
agggattgttttcag

SEQ ID NO: 487493 - DNA, 15 bp, Homo sapiens
gggattgttttcaga

SEQ ID NO: 487494 - DNA, 15 bp, Homo sapiens
ggattgttttcagat

SEQ ID NO: 487495 - DNA, 15 bp, Homo sapiens
gattgttttcagatt

SEQ ID NO: 487496 - DNA, 15 bp, Homo sapiens
attgttttcagattt

SEQ ID NO: 487497 - DNA, 15 bp, Homo sapiens
ttgttttcagatttt

SEQ ID NO: 487498 - DNA, 15 bp, Homo sapiens
tgttttcagattttc

SEQ ID NO: 487499 - DNA, 15 bp, Homo sapiens
gttttcagattttcc

SEQ ID NO: 487500 - DNA, 15 bp, Homo sapiens
ttttcagattttccc

SEQ ID NO: 487501 - DNA, 15 bp, Homo sapiens
tttcagattttccct

SEQ ID NO: 487502 - DNA, 15 bp, Homo sapiens
ttcagattttccctt

SEQ ID NO: 487503 - DNA, 15 bp, Homo sapiens
tcagattttcccttt

SEQ ID NO: 487504 - DNA, 15 bp, Homo sapiens
cagattttccctttt

SEQ ID NO: 487505 - DNA, 15 bp, Homo sapiens
agattttcccttttt

SEQ ID NO: 487506 - DNA, 15 bp, Homo sapiens
gattttcccttttta

SEQ ID NO: 487507 - DNA, 15 bp, Homo sapiens
attttccctttttat

SEQ ID NO: 487508 - DNA, 15 bp, Homo sapiens
ttttccctttttatt

SEQ ID NO: 487509 - DNA, 15 bp, Homo sapiens
tttccctttttattc

SEQ ID NO: 487510 - DNA, 15 bp, Homo sapiens
ttccctttttattcc

SEQ ID NO: 487511 - DNA, 15 bp, Homo sapiens
tccctttttattccc

SEQ ID NO: 487512 - DNA, 15 bp, Homo sapiens
ccctttttattcccg

SEQ ID NO: 487513 - DNA, 15 bp, Homo sapiens
cctttttattcccgc

SEQ ID NO: 487514 - DNA, 15 bp, Homo sapiens
ctttttattcccgct

SEQ ID NO: 487515 - DNA, 15 bp, Homo sapiens
tttttattcccgctg

SEQ ID NO: 487516 - DNA, 15 bp, Homo sapiens
ttttattcccgctgg

SEQ ID NO: 487517 - DNA, 15 bp, Homo sapiens
tttattcccgctggt

SEQ ID NO: 487518 - DNA, 15 bp, Homo sapiens
ttattcccgctggtt

SEQ ID NO: 487519 - DNA, 15 bp, Homo sapiens
tattcccgctggttt

SEQ ID NO: 487520 - DNA, 15 bp, Homo sapiens
attcccgctggtttc

SEQ ID NO: 487521 - DNA, 15 bp, Homo sapiens
ttcccgctggtttct

SEQ ID NO: 487522 - DNA, 15 bp, Homo sapiens
tcccgctggtttctt

SEQ ID NO: 487523 - DNA, 15 bp, Homo sapiens
cccgctggtttcttt

SEQ ID NO: 487524 - DNA, 15 bp, Homo sapiens
ccgctggtttctttt

SEQ ID NO: 487525 - DNA, 15 bp, Homo sapiens
cgctggtttcttttc

SEQ ID NO: 487526 - DNA, 15 bp, Homo sapiens
gctggtttcttttct

SEQ ID NO: 487527 - DNA, 15 bp, Homo sapiens
ctggtttcttttctc

SEQ ID NO: 487528 - DNA, 15 bp, Homo sapiens
tggtttcttttctca

SEQ ID NO: 487529 - DNA, 15 bp, Homo sapiens
ggtttcttttctcat

SEQ ID NO: 487530 - DNA, 15 bp, Homo sapiens
gtttcttttctcatg

SEQ ID NO: 487531 - DNA, 15 bp, Homo sapiens
tttcttttctcatgg

SEQ ID NO: 487532 - DNA, 15 bp, Homo sapiens
ttcttttctcatgga

SEQ ID NO: 487533 - DNA, 15 bp, Homo sapiens
tcttttctcatggaa

SEQ ID NO: 487534 - DNA, 15 bp, Homo sapiens
cttttctcatggaat

SEQ ID NO: 487535 - DNA, 15 bp, Homo sapiens
ttttctcatggaata

SEQ ID NO: 487536 - DNA, 15 bp, Homo sapiens
tttctcatggaataa

SEQ ID NO: 487537 - DNA, 15 bp, Homo sapiens
ttctcatggaataaa

SEQ ID NO: 487538 - DNA, 15 bp, Homo sapiens
tctcatggaataaaa

SEQ ID NO: 487539 - DNA, 15 bp, Homo sapiens
ctcatggaataaaat

SEQ ID NO: 487540 - DNA, 15 bp, Homo sapiens
tcatggaataaaata

SEQ ID NO: 487541 - DNA, 15 bp, Homo sapiens
catggaataaaatag

SEQ ID NO: 487542 - DNA, 15 bp, Homo sapiens
atggaataaaatagt

SEQ ID NO: 487543 - DNA, 15 bp, Homo sapiens
tggaataaaatagtc

SEQ ID NO: 487544 - DNA, 15 bp, Homo sapiens
ggaataaaatagtca

SEQ ID NO: 487545 - DNA, 15 bp, Homo sapiens
gaataaaatagtcat

SEQ ID NO: 487546 - DNA, 15 bp, Homo sapiens
aataaaatagtcatt

SEQ ID NO: 487547 - DNA, 15 bp, Homo sapiens
ataaaatagtcattg

SEQ ID NO: 487548 - DNA, 15 bp, Homo sapiens
taaaatagtcattgt

SEQ ID NO: 487549 - DNA, 15 bp, Homo sapiens
aaaatagtcattgta

SEQ ID NO: 487550 - DNA, 15 bp, Homo sapiens
aaatagtcattgtat

SEQ ID NO: 487551 - DNA, 15 bp, Homo sapiens
aatagtcattgtata

SEQ ID NO: 487552 - DNA, 15 bp, Homo sapiens
atagtcattgtataa

SEQ ID NO: 487553 - DNA, 15 bp, Homo sapiens
tagtcattgtataaa

SEQ ID NO: 487554 - DNA, 15 bp, Homo sapiens
agtcattgtataaag

SEQ ID NO: 487555 - DNA, 15 bp, Homo sapiens
gtcattgtataaagg

SEQ ID NO: 487556 - DNA, 15 bp, Homo sapiens
tcattgtataaaggc

SEQ ID NO: 487557 - DNA, 15 bp, Homo sapiens
cattgtataaaggcc

SEQ ID NO: 487558 - DNA, 15 bp, Homo sapiens
attgtataaaggcca

SEQ ID NO: 487559 - DNA, 15 bp, Homo sapiens
ttgtataaaggccaa

SEQ ID NO: 487560 - DNA, 15 bp, Homo sapiens
tgtataaaggccaaa

SEQ ID NO: 487561 - DNA, 15 bp, Homo sapiens
gtataaaggccaaac

SEQ ID NO: 487562 - DNA, 15 bp, Homo sapiens
tataaaggccaaaca

SEQ ID NO: 487563 - DNA, 15 bp, Homo sapiens
ataaaggccaaacaa

SEQ ID NO: 487564 - DNA, 15 bp, Homo sapiens
taaaggccaaacaat

SEQ ID NO: 487565 - DNA, 15 bp, Homo sapiens
aaaggccaaacaatt

SEQ ID NO: 487566 - DNA, 15 bp, Homo sapiens
aaggccaaacaattt

SEQ ID NO: 487567 - DNA, 15 bp, Homo sapiens
aggccaaacaattta

SEQ ID NO: 487568 - DNA, 15 bp, Homo sapiens
ggccaaacaatttaa

SEQ ID NO: 487569 - DNA, 15 bp, Homo sapiens
gccaaacaatttaag

SEQ ID NO: 487570 - DNA, 15 bp, Homo sapiens
ccaaacaatttaagt

SEQ ID NO: 487571 - DNA, 15 bp, Homo sapiens
caaacaatttaagtc

SEQ ID NO: 487572 - DNA, 15 bp, Homo sapiens
aaacaatttaagtca

SEQ ID NO: 487573 - DNA, 15 bp, Homo sapiens
aacaatttaagtcat

SEQ ID NO: 487574 - DNA, 15 bp, Homo sapiens
acaatttaagtcatc

SEQ ID NO: 487575 - DNA, 15 bp, Homo sapiens
caatttaagtcatca

SEQ ID NO: 487576 - DNA, 15 bp, Homo sapiens
aatttaagtcatcat

SEQ ID NO: 487577 - DNA, 15 bp, Homo sapiens
atttaagtcatcata

SEQ ID NO: 487578 - DNA, 15 bp, Homo sapiens
tttaagtcatcatag

SEQ ID NO: 487579 - DNA, 15 bp, Homo sapiens
ttaagtcatcataga

SEQ ID NO: 487580 - DNA, 15 bp, Homo sapiens
taagtcatcatagat

SEQ ID NO: 487581 - DNA, 15 bp, Homo sapiens
aagtcatcatagatt

SEQ ID NO: 487582 - DNA, 15 bp, Homo sapiens
agtcatcatagatta

SEQ ID NO: 487583 - DNA, 15 bp, Homo sapiens
gtcatcatagattag

SEQ ID NO: 487584 - DNA, 15 bp, Homo sapiens
tcatcatagattagg

SEQ ID NO: 487585 - DNA, 15 bp, Homo sapiens
catcatagattagga

SEQ ID NO: 487586 - DNA, 15 bp, Homo sapiens
atcatagattaggat

SEQ ID NO: 487587 - DNA, 15 bp, Homo sapiens
tcatagattaggatc

SEQ ID NO: 487588 - DNA, 15 bp, Homo sapiens
catagattaggatcc

SEQ ID NO: 487589 - DNA, 15 bp, Homo sapiens
atagattaggatcct

SEQ ID NO: 487590 - DNA, 15 bp, Homo sapiens
tagattaggatcctg

SEQ ID NO: 487591 - DNA, 15 bp, Homo sapiens
agattaggatcctgt

SEQ ID NO: 487592 - DNA, 15 bp, Homo sapiens
gattaggatcctgtg

SEQ ID NO: 487593 - DNA, 15 bp, Homo sapiens
attaggatcctgtga

SEQ ID NO: 487594 - DNA, 15 bp, Homo sapiens
ttaggatcctgtgaa

SEQ ID NO: 487595 - DNA, 15 bp, Homo sapiens
taggatcctgtgaag

SEQ ID NO: 487596 - DNA, 15 bp, Homo sapiens
aggatcctgtgaagt

SEQ ID NO: 487597 - DNA, 15 bp, Homo sapiens
ggatcctgtgaagtt

SEQ ID NO: 487598 - DNA, 15 bp, Homo sapiens
gatcctgtgaagttt

SEQ ID NO: 487599 - DNA, 15 bp, Homo sapiens
atcctgtgaagtttc

SEQ ID NO: 487600 - DNA, 15 bp, Homo sapiens
tcctgtgaagtttcc

SEQ ID NO: 487601 - DNA, 15 bp, Homo sapiens
cctgtgaagtttcca

SEQ ID NO: 487602 - DNA, 15 bp, Homo sapiens
ctgtgaagtttccat

SEQ ID NO: 487603 - DNA, 15 bp, Homo sapiens
tgtgaagtttccatc

SEQ ID NO: 487604 - DNA, 15 bp, Homo sapiens
gtgaagtttccatct

SEQ ID NO: 487605 - DNA, 15 bp, Homo sapiens
tgaagtttccatctg

SEQ ID NO: 487606 - DNA, 15 bp, Homo sapiens
gaagtttccatctga

SEQ ID NO: 487607 - DNA, 15 bp, Homo sapiens
aagtttccatctgaa

SEQ ID NO: 487608 - DNA, 15 bp, Homo sapiens
agtttccatctgaac

SEQ ID NO: 487609 - DNA, 15 bp, Homo sapiens
gtttccatctgaaca

SEQ ID NO: 487610 - DNA, 15 bp, Homo sapiens
tttccatctgaacaa

SEQ ID NO: 487611 - DNA, 15 bp, Homo sapiens
ttccatctgaacaac

SEQ ID NO: 487612 - DNA, 15 bp, Homo sapiens
tccatctgaacaacc

SEQ ID NO: 487613 - DNA, 15 bp, Homo sapiens
ccatctgaacaacca

SEQ ID NO: 487614 - DNA, 15 bp, Homo sapiens
catctgaacaaccaa

SEQ ID NO: 487615 - DNA, 15 bp, Homo sapiens
atctgaacaaccaag

SEQ ID NO: 487616 - DNA, 15 bp, Homo sapiens
tctgaacaaccaaga

SEQ ID NO: 487617 - DNA, 15 bp, Homo sapiens
ctgaacaaccaagag

SEQ ID NO: 487618 - DNA, 15 bp, Homo sapiens
tgaacaaccaagagc

SEQ ID NO: 487619 - DNA, 15 bp, Homo sapiens
gaacaaccaagagcc

SEQ ID NO: 487620 - DNA, 15 bp, Homo sapiens
aacaaccaagagcca

SEQ ID NO: 487621 - DNA, 15 bp, Homo sapiens
acaaccaagagccag

SEQ ID NO: 487622 - DNA, 15 bp, Homo sapiens
caaccaagagccaga

SEQ ID NO: 487623 - DNA, 15 bp, Homo sapiens
aaccaagagccagaa

SEQ ID NO: 487624 - DNA, 15 bp, Homo sapiens
accaagagccagaaa

SEQ ID NO: 487625 - DNA, 15 bp, Homo sapiens
ccaagagccagaaaa

SEQ ID NO: 487626 - DNA, 15 bp, Homo sapiens
caagagccagaaaat

SEQ ID NO: 487627 - DNA, 15 bp, Homo sapiens
aagagccagaaaata

SEQ ID NO: 487628 - DNA, 15 bp, Homo sapiens
agagccagaaaataa

SEQ ID NO: 487629 - DNA, 15 bp, Homo sapiens
gagccagaaaataac

SEQ ID NO: 487630 - DNA, 15 bp, Homo sapiens
agccagaaaataacc

SEQ ID NO: 487631 - DNA, 15 bp, Homo sapiens
gccagaaaataacca

SEQ ID NO: 487632 - DNA, 15 bp, Homo sapiens
ccagaaaataaccaa

SEQ ID NO: 487633 - DNA, 15 bp, Homo sapiens
cagaaaataaccaaa

SEQ ID NO: 487634 - DNA, 15 bp, Homo sapiens
agaaaataaccaaat

SEQ ID NO: 487635 - DNA, 15 bp, Homo sapiens
gaaaataaccaaatt

SEQ ID NO: 487636 - DNA, 15 bp, Homo sapiens
aaaataaccaaattc

SEQ ID NO: 487637 - DNA, 15 bp, Homo sapiens
aaataaccaaattcc

SEQ ID NO: 487638 - DNA, 15 bp, Homo sapiens
aataaccaaattcct

SEQ ID NO: 487639 - DNA, 15 bp, Homo sapiens
ataaccaaattcctg

SEQ ID NO: 487640 - DNA, 15 bp, Homo sapiens
taaccaaattcctgg

SEQ ID NO: 487641 - DNA, 15 bp, Homo sapiens
aaccaaattcctggg

SEQ ID NO: 487642 - DNA, 15 bp, Homo sapiens
accaaattcctgggg

SEQ ID NO: 487643 - DNA, 15 bp, Homo sapiens
ccaaattcctgggga

SEQ ID NO: 487644 - DNA, 15 bp, Homo sapiens
caaattcctggggaa

SEQ ID NO: 487645 - DNA, 15 bp, Homo sapiens
aaattcctggggaaa

SEQ ID NO: 487646 - DNA, 15 bp, Homo sapiens
aattcctggggaaat

SEQ ID NO: 487647 - DNA, 15 bp, Homo sapiens
attcctggggaaatt

SEQ ID NO: 487648 - DNA, 15 bp, Homo sapiens
ttcctggggaaatta

SEQ ID NO: 487649 - DNA, 15 bp, Homo sapiens
tcctggggaaattat

SEQ ID NO: 487650 - DNA, 15 bp, Homo sapiens
cctggggaaattata

SEQ ID NO: 487651 - DNA, 15 bp, Homo sapiens
ctggggaaattatat

SEQ ID NO: 487652 - DNA, 15 bp, Homo sapiens
tggggaaattatata

SEQ ID NO: 487653 - DNA, 15 bp, Homo sapiens
ggggaaattatataa

SEQ ID NO: 487654 - DNA, 15 bp, Homo sapiens
gggaaattatataat

SEQ ID NO: 487655 - DNA, 15 bp, Homo sapiens
ggaaattatataata

SEQ ID NO: 487656 - DNA, 15 bp, Homo sapiens
gaaattatataataa

SEQ ID NO: 487657 - DNA, 15 bp, Homo sapiens
aaattatataataat

SEQ ID NO: 487658 - DNA, 15 bp, Homo sapiens
aattatataataatt

SEQ ID NO: 487659 - DNA, 15 bp, Homo sapiens
attatataataattc

SEQ ID NO: 487660 - DNA, 15 bp, Homo sapiens
ttatataataattct

SEQ ID NO: 487661 - DNA, 15 bp, Homo sapiens
tatataataattctt

SEQ ID NO: 487662 - DNA, 15 bp, Homo sapiens
tataataattcttac

SEQ ID NO: 487663 - DNA, 15 bp, Homo sapiens
ataataattcttact

SEQ ID NO: 487664 - DNA, 15 bp, Homo sapiens
taataattcttactt

SEQ ID NO: 487665 - DNA, 15 bp, Homo sapiens
aataattcttactta

SEQ ID NO: 487666 - DNA, 15 bp, Homo sapiens
ataattcttacttat

SEQ ID NO: 487667 - DNA, 15 bp, Homo sapiens
taattcttacttatt

SEQ ID NO: 487668 - DNA, 15 bp, Homo sapiens
aattcttacttattc

SEQ ID NO: 487669 - DNA, 15 bp, Homo sapiens
attcttacttattca

SEQ ID NO: 487670 - DNA, 15 bp, Homo sapiens
ttcttacttattcat

SEQ ID NO: 487671 - DNA, 15 bp, Homo sapiens
tcttacttattcatt

SEQ ID NO: 487672 - DNA, 15 bp, Homo sapiens
cttacttattcattt

SEQ ID NO: 487673 - DNA, 15 bp, Homo sapiens
ttacttattcatttt

SEQ ID NO: 487674 - DNA, 15 bp, Homo sapiens
tacttattcattttt

SEQ ID NO: 487675 - DNA, 15 bp, Homo sapiens
acttattcatttttt

SEQ ID NO: 487676 - DNA, 15 bp, Homo sapiens
cttattcattttttc

SEQ ID NO: 487677 - DNA, 15 bp, Homo sapiens
ttattcattttttcc

SEQ ID NO: 487678 - DNA, 15 bp, Homo sapiens
tattcattttttcca

SEQ ID NO: 487679 - DNA, 15 bp, Homo sapiens
attcattttttccaa

SEQ ID NO: 487680 - DNA, 15 bp, Homo sapiens
ttcattttttccaag

SEQ ID NO: 487681 - DNA, 15 bp, Homo sapiens
tcattttttccaagt

SEQ ID NO: 487682 - DNA, 15 bp, Homo sapiens
cattttttccaagtg

SEQ ID NO: 487683 - DNA, 15 bp, Homo sapiens
attttttccaagtgt

SEQ ID NO: 487684 - DNA, 15 bp, Homo sapiens
ttttttccaagtgtt

SEQ ID NO: 487685 - DNA, 15 bp, Homo sapiens
tttttccaagtgttt

SEQ ID NO: 487686 - DNA, 15 bp, Homo sapiens
ttttccaagtgtttt

SEQ ID NO: 487687 - DNA, 15 bp, Homo sapiens
tttccaagtgttttg

SEQ ID NO: 487688 - DNA, 15 bp, Homo sapiens
ttccaagtgttttgt

SEQ ID NO: 487689 - DNA, 15 bp, Homo sapiens
tccaagtgttttgtc

SEQ ID NO: 487690 - DNA, 15 bp, Homo sapiens
ccaagtgttttgtct

SEQ ID NO: 487691 - DNA, 15 bp, Homo sapiens
caagtgttttgtctt

SEQ ID NO: 487692 - DNA, 15 bp, Homo sapiens
aagtgttttgtcttc

SEQ ID NO: 487693 - DNA, 15 bp, Homo sapiens
agtgttttgtcttca

SEQ ID NO: 487694 - DNA, 15 bp, Homo sapiens
gtgttttgtcttcag

SEQ ID NO: 487695 - DNA, 15 bp, Homo sapiens
tgttttgtcttcagc

SEQ ID NO: 487696 - DNA, 15 bp, Homo sapiens
gttttgtcttcagca

SEQ ID NO: 487697 - DNA, 15 bp, Homo sapiens
ttttgtcttcagcac

SEQ ID NO: 487698 - DNA, 15 bp, Homo sapiens
tttgtcttcagcacc

SEQ ID NO: 487699 - DNA, 15 bp, Homo sapiens
ttgtcttcagcacct

SEQ ID NO: 487700 - DNA, 15 bp, Homo sapiens
tgtcttcagcacctt

SEQ ID NO: 487701 - DNA, 15 bp, Homo sapiens
gtcttcagcaccttg

SEQ ID NO: 487702 - DNA, 15 bp, Homo sapiens
tcttcagcaccttgc

SEQ ID NO: 487703 - DNA, 15 bp, Homo sapiens
cttcagcaccttgcc

SEQ ID NO: 487704 - DNA, 15 bp, Homo sapiens
ttcagcaccttgcca

SEQ ID NO: 487705 - DNA, 15 bp, Homo sapiens
tcagcaccttgccac

SEQ ID NO: 487706 - DNA, 15 bp, Homo sapiens
cagcaccttgccacc

SEQ ID NO: 487707 - DNA, 15 bp, Homo sapiens
agcaccttgccacct

SEQ ID NO: 487708 - DNA, 15 bp, Homo sapiens
gcaccttgccacctt

SEQ ID NO: 487709 - DNA, 15 bp, Homo sapiens
caccttgccaccttg

SEQ ID NO: 487710 - DNA, 15 bp, Homo sapiens
accttgccaccttgc

SEQ ID NO: 487711 - DNA, 15 bp, Homo sapiens
ccttgccaccttgca

SEQ ID NO: 487712 - DNA, 15 bp, Homo sapiens
cttgccaccttgcaa

SEQ ID NO: 487713 - DNA, 15 bp, Homo sapiens
ttgccaccttgcaat

SEQ ID NO: 487714 - DNA, 15 bp, Homo sapiens
tgccaccttgcaatt

SEQ ID NO: 487715 - DNA, 15 bp, Homo sapiens
gccaccttgcaattt

SEQ ID NO: 487716 - DNA, 15 bp, Homo sapiens
ccaccttgcaatttt

SEQ ID NO: 487717 - DNA, 15 bp, Homo sapiens
caccttgcaattttg

SEQ ID NO: 487718 - DNA, 15 bp, Homo sapiens
accttgcaattttgg

SEQ ID NO: 487719 - DNA, 15 bp, Homo sapiens
ccttgcaattttggc

SEQ ID NO: 487720 - DNA, 15 bp, Homo sapiens
cttgcaattttggct

SEQ ID NO: 487721 - DNA, 15 bp, Homo sapiens
ttgcaattttggctg

SEQ ID NO: 487722 - DNA, 15 bp, Homo sapiens
tgcaattttggctga

SEQ ID NO: 487723 - DNA, 15 bp, Homo sapiens
gcaattttggctgag

SEQ ID NO: 487724 - DNA, 15 bp, Homo sapiens
caattttggctgagc

SEQ ID NO: 487725 - DNA, 15 bp, Homo sapiens
aattttggctgagct

SEQ ID NO: 487726 - DNA, 15 bp, Homo sapiens
attttggctgagctc

SEQ ID NO: 487727 - DNA, 15 bp, Homo sapiens
ttttggctgagctct

SEQ ID NO: 487728 - DNA, 15 bp, Homo sapiens
tttggctgagctctc

SEQ ID NO: 487729 - DNA, 15 bp, Homo sapiens
ttggctgagctctca

SEQ ID NO: 487730 - DNA, 15 bp, Homo sapiens
tggctgagctctcac

SEQ ID NO: 487731 - DNA, 15 bp, Homo sapiens
ggctgagctctcacc

SEQ ID NO: 487732 - DNA, 15 bp, Homo sapiens
gctgagctctcacct

SEQ ID NO: 487733 - DNA, 15 bp, Homo sapiens
ctgagctctcaccta

SEQ ID NO: 487734 - DNA, 15 bp, Homo sapiens
tgagctctcacctaa

SEQ ID NO: 487735 - DNA, 15 bp, Homo sapiens
gagctctcacctaaa

SEQ ID NO: 487736 - DNA, 15 bp, Homo sapiens
agctctcacctaaaa

SEQ ID NO: 487737 - DNA, 15 bp, Homo sapiens
gctctcacctaaaac

SEQ ID NO: 487738 - DNA, 15 bp, Homo sapiens
ctctcacctaaaaca

SEQ ID NO: 487739 - DNA, 15 bp, Homo sapiens
tctcacctaaaacac

SEQ ID NO: 487740 - DNA, 15 bp, Homo sapiens
ctcacctaaaacact

SEQ ID NO: 487741 - DNA, 15 bp, Homo sapiens
tcacctaaaacactt

SEQ ID NO: 487742 - DNA, 15 bp, Homo sapiens
cacctaaaacacttc

SEQ ID NO: 487743 - DNA, 15 bp, Homo sapiens
acctaaaacacttct

SEQ ID NO: 487744 - DNA, 15 bp, Homo sapiens
cctaaaacacttctg

SEQ ID NO: 487745 - DNA, 15 bp, Homo sapiens
ctaaaacacttctgg

SEQ ID NO: 487746 - DNA, 15 bp, Homo sapiens
taaaacacttctggt

SEQ ID NO: 487747 - DNA, 15 bp, Homo sapiens
aaaacacttctggtg

SEQ ID NO: 487748 - DNA, 15 bp, Homo sapiens
aaacacttctggtgt

SEQ ID NO: 487749 - DNA, 15 bp, Homo sapiens
aacacttctggtgtt

SEQ ID NO: 487750 - DNA, 15 bp, Homo sapiens
acacttctggtgttt

SEQ ID NO: 487751 - DNA, 15 bp, Homo sapiens
cacttctggtgtttc

SEQ ID NO: 487752 - DNA, 15 bp, Homo sapiens
acttctggtgtttct

SEQ ID NO: 487753 - DNA, 15 bp, Homo sapiens
cttctggtgtttcta

SEQ ID NO: 487754 - DNA, 15 bp, Homo sapiens
ttctggtgtttctag

SEQ ID NO: 487755 - DNA, 15 bp, Homo sapiens
tctggtgtttctagc

SEQ ID NO: 487756 - DNA, 15 bp, Homo sapiens
ctggtgtttctagca

SEQ ID NO: 487757 - DNA, 15 bp, Homo sapiens
tggtgtttctagcag

SEQ ID NO: 487758 - DNA, 15 bp, Homo sapiens
ggtgtttctagcaga

SEQ ID NO: 487759 - DNA, 15 bp, Homo sapiens
gtgtttctagcagaa

SEQ ID NO: 487760 - DNA, 15 bp, Homo sapiens
tgtttctagcagaat

SEQ ID NO: 487761 - DNA, 15 bp, Homo sapiens
gtttctagcagaata

SEQ ID NO: 487762 - DNA, 15 bp, Homo sapiens
tttctagcagaatat

SEQ ID NO: 487763 - DNA, 15 bp, Homo sapiens
ttctagcagaatata

SEQ ID NO: 487764 - DNA, 15 bp, Homo sapiens
tctagcagaatatat

SEQ ID NO: 487765 - DNA, 15 bp, Homo sapiens
ctagcagaatatata

SEQ ID NO: 487766 - DNA, 15 bp, Homo sapiens
tagcagaatatatac

SEQ ID NO: 487767 - DNA, 15 bp, Homo sapiens
agcagaatatataca

SEQ ID NO: 487768 - DNA, 15 bp, Homo sapiens
gcagaatatatacat

SEQ ID NO: 487769 - DNA, 15 bp, Homo sapiens
cagaatatatacata

SEQ ID NO: 487770 - DNA, 15 bp, Homo sapiens
agaatatatacatac

SEQ ID NO: 487771 - DNA, 15 bp, Homo sapiens
gaatatatacataca

SEQ ID NO: 487772 - DNA, 15 bp, Homo sapiens
aatatatacatacaa

SEQ ID NO: 487773 - DNA, 15 bp, Homo sapiens
atatatacatacaag

SEQ ID NO: 487774 - DNA, 15 bp, Homo sapiens
tatatacatacaagt

SEQ ID NO: 487775 - DNA, 15 bp, Homo sapiens
atatacatacaagta

SEQ ID NO: 487776 - DNA, 15 bp, Homo sapiens
tatacatacaagtaa

SEQ ID NO: 487777 - DNA, 15 bp, Homo sapiens
atacatacaagtaaa

SEQ ID NO: 487778 - DNA, 15 bp, Homo sapiens
tacatacaagtaaac

SEQ ID NO: 487779 - DNA, 15 bp, Homo sapiens
acatacaagtaaact

SEQ ID NO: 487780 - DNA, 15 bp, Homo sapiens
catacaagtaaactg

SEQ ID NO: 487781 - DNA, 15 bp, Homo sapiens
atacaagtaaactgt

SEQ ID NO: 487782 - DNA, 15 bp, Homo sapiens
tacaagtaaactgta

SEQ ID NO: 487783 - DNA, 15 bp, Homo sapiens
acaagtaaactgtat

SEQ ID NO: 487784 - DNA, 15 bp, Homo sapiens
caagtaaactgtata

SEQ ID NO: 487785 - DNA, 15 bp, Homo sapiens
aagtaaactgtatat

SEQ ID NO: 487786 - DNA, 15 bp, Homo sapiens
agtaaactgtatata

SEQ ID NO: 487787 - DNA, 15 bp, Homo sapiens
gtaaactgtatatat

SEQ ID NO: 487788 - DNA, 15 bp, Homo sapiens
taaactgtatatatg

SEQ ID NO: 487789 - DNA, 15 bp, Homo sapiens
aaactgtatatatgt

SEQ ID NO: 487790 - DNA, 15 bp, Homo sapiens
aactgtatatatgta

SEQ ID NO: 487791 - DNA, 15 bp, Homo sapiens
actgtatatatgtat

SEQ ID NO: 487792 - DNA, 15 bp, Homo sapiens
ctgtatatatgtata

SEQ ID NO: 487793 - DNA, 15 bp, Homo sapiens
tgtatatatgtatac

SEQ ID NO: 487794 - DNA, 15 bp, Homo sapiens
gtatatatgtataca

SEQ ID NO: 487795 - DNA, 15 bp, Homo sapiens
tatacatatatatac

SEQ ID NO: 487796 - DNA, 15 bp, Homo sapiens
atacatatatataca

SEQ ID NO: 487797 - DNA, 15 bp, Homo sapiens
tacatatatatacac

SEQ ID NO: 487798 - DNA, 15 bp, Homo sapiens
acatatatatacaca

SEQ ID NO: 487799 - DNA, 15 bp, Homo sapiens
catatatatacacac

SEQ ID NO: 487800 - DNA, 15 bp, Homo sapiens
cacacacatacaaat

SEQ ID NO: 487801 - DNA, 15 bp, Homo sapiens
acacacatacaaata

SEQ ID NO: 487802 - DNA, 15 bp, Homo sapiens
cacacatacaaatat

SEQ ID NO: 487803 - DNA, 15 bp, Homo sapiens
acacatacaaatata

SEQ ID NO: 487804 - DNA, 15 bp, Homo sapiens
cacatacaaatatat

SEQ ID NO: 487805 - DNA, 15 bp, Homo sapiens
acatacaaatatata

SEQ ID NO: 487806 - DNA, 15 bp, Homo sapiens
catacaaatatataa

SEQ ID NO: 487807 - DNA, 15 bp, Homo sapiens
atacaaatatataaa

SEQ ID NO: 487808 - DNA, 15 bp, Homo sapiens
tacaaatatataaat

SEQ ID NO: 487809 - DNA, 15 bp, Homo sapiens
acaaatatataaatg

SEQ ID NO: 487810 - DNA, 15 bp, Homo sapiens
caaatatataaatgc

SEQ ID NO: 487811 - DNA, 15 bp, Homo sapiens
aaatatataaatgca

SEQ ID NO: 487812 - DNA, 15 bp, Homo sapiens
aatatataaatgcat

SEQ ID NO: 487813 - DNA, 15 bp, Homo sapiens
atatataaatgcata

SEQ ID NO: 487814 - DNA, 15 bp, Homo sapiens
tatataaatgcatat

SEQ ID NO: 487815 - DNA, 15 bp, Homo sapiens
atataaatgcatata

SEQ ID NO: 487816 - DNA, 15 bp, Homo sapiens
tataaatgcatataa

SEQ ID NO: 487817 - DNA, 15 bp, Homo sapiens
ataaatgcatataaa

SEQ ID NO: 487818 - DNA, 15 bp, Homo sapiens
taaatgcatataaat

SEQ ID NO: 487819 - DNA, 15 bp, Homo sapiens
aaatgcatataaatt

SEQ ID NO: 487820 - DNA, 15 bp, Homo sapiens
aatgcatataaatta

SEQ ID NO: 487821 - DNA, 15 bp, Homo sapiens
atgcatataaattac

SEQ ID NO: 487822 - DNA, 15 bp, Homo sapiens
tgcatataaattact

SEQ ID NO: 487823 - DNA, 15 bp, Homo sapiens
gcatataaattactt

SEQ ID NO: 487824 - DNA, 15 bp, Homo sapiens
catataaattactta

SEQ ID NO: 487825 - DNA, 15 bp, Homo sapiens
atataaattacttag

SEQ ID NO: 487826 - DNA, 15 bp, Homo sapiens
tataaattacttagt

SEQ ID NO: 487827 - DNA, 15 bp, Homo sapiens
ataaattacttagta

SEQ ID NO: 487828 - DNA, 15 bp, Homo sapiens
taaattacttagtac

SEQ ID NO: 487829 - DNA, 15 bp, Homo sapiens
aaattacttagtact

SEQ ID NO: 487830 - DNA, 15 bp, Homo sapiens
aattacttagtacta

SEQ ID NO: 487831 - DNA, 15 bp, Homo sapiens
attacttagtactat

SEQ ID NO: 487832 - DNA, 15 bp, Homo sapiens
ttacttagtactata

SEQ ID NO: 487833 - DNA, 15 bp, Homo sapiens
tacttagtactataa

SEQ ID NO: 487834 - DNA, 15 bp, Homo sapiens
acttagtactataat

SEQ ID NO: 487835 - DNA, 15 bp, Homo sapiens
cttagtactataatt

SEQ ID NO: 487836 - DNA, 15 bp, Homo sapiens
ttagtactataatta

SEQ ID NO: 487837 - DNA, 15 bp, Homo sapiens
tagtactataattat

SEQ ID NO: 487838 - DNA, 15 bp, Homo sapiens
agtactataattata

SEQ ID NO: 487839 - DNA, 15 bp, Homo sapiens
gtactataattatat

SEQ ID NO: 487840 - DNA, 15 bp, Homo sapiens
tactataattatatt

SEQ ID NO: 487841 - DNA, 15 bp, Homo sapiens
actataattatattt

SEQ ID NO: 487842 - DNA, 15 bp, Homo sapiens
ctataattatatttt

SEQ ID NO: 487843 - DNA, 15 bp, Homo sapiens
tataattatatttta

SEQ ID NO: 487844 - DNA, 15 bp, Homo sapiens
ataattatattttaa

SEQ ID NO: 487845 - DNA, 15 bp, Homo sapiens
taattatattttaaa

SEQ ID NO: 487846 - DNA, 15 bp, Homo sapiens
aattatattttaaat

SEQ ID NO: 487847 - DNA, 15 bp, Homo sapiens
attatattttaaata

SEQ ID NO: 487848 - DNA, 15 bp, Homo sapiens
ttatattttaaataa

SEQ ID NO: 487849 - DNA, 15 bp, Homo sapiens
tatattttaaataat

SEQ ID NO: 487850 - DNA, 15 bp, Homo sapiens
atattttaaataatc

SEQ ID NO: 487851 - DNA, 15 bp, Homo sapiens
tattttaaataatct

SEQ ID NO: 487852 - DNA, 15 bp, Homo sapiens
attttaaataatctt

SEQ ID NO: 487853 - DNA, 15 bp, Homo sapiens
ttttaaataatcttt

SEQ ID NO: 487854 - DNA, 15 bp, Homo sapiens
tttaaataatctttg

SEQ ID NO: 487855 - DNA, 15 bp, Homo sapiens
ttaaataatctttga

SEQ ID NO: 487856 - DNA, 15 bp, Homo sapiens
taaataatctttgac

SEQ ID NO: 487857 - DNA, 15 bp, Homo sapiens
aaataatctttgaca

SEQ ID NO: 487858 - DNA, 15 bp, Homo sapiens
aataatctttgacag

SEQ ID NO: 487859 - DNA, 15 bp, Homo sapiens
ataatctttgacagg

SEQ ID NO: 487860 - DNA, 15 bp, Homo sapiens
taatctttgacagga

SEQ ID NO: 487861 - DNA, 15 bp, Homo sapiens
aatctttgacaggat

SEQ ID NO: 487862 - DNA, 15 bp, Homo sapiens
atctttgacaggatt

SEQ ID NO: 487863 - DNA, 15 bp, Homo sapiens
tctttgacaggattt

SEQ ID NO: 487864 - DNA, 15 bp, Homo sapiens
ctttgacaggatttg

SEQ ID NO: 487865 - DNA, 15 bp, Homo sapiens
tttgacaggatttga

SEQ ID NO: 487866 - DNA, 15 bp, Homo sapiens
ttgacaggatttgaa

SEQ ID NO: 487867 - DNA, 15 bp, Homo sapiens
tgacaggatttgaag

SEQ ID NO: 487868 - DNA, 15 bp, Homo sapiens
gacaggatttgaaga

SEQ ID NO: 487869 - DNA, 15 bp, Homo sapiens
acaggatttgaagac

SEQ ID NO: 487870 - DNA, 15 bp, Homo sapiens
caggatttgaagaca

SEQ ID NO: 487871 - DNA, 15 bp, Homo sapiens
aggatttgaagacat

SEQ ID NO: 487872 - DNA, 15 bp, Homo sapiens
ggatttgaagacatt

SEQ ID NO: 487873 - DNA, 15 bp, Homo sapiens
gatttgaagacatta

SEQ ID NO: 487874 - DNA, 15 bp, Homo sapiens
atttgaagacattat

SEQ ID NO: 487875 - DNA, 15 bp, Homo sapiens
tttgaagacattatt

SEQ ID NO: 487876 - DNA, 15 bp, Homo sapiens
ttgaagacattattt

SEQ ID NO: 487877 - DNA, 15 bp, Homo sapiens
tgaagacattatttg

SEQ ID NO: 487878 - DNA, 15 bp, Homo sapiens
gaagacattatttgt

SEQ ID NO: 487879 - DNA, 15 bp, Homo sapiens
aagacattatttgta

SEQ ID NO: 487880 - DNA, 15 bp, Homo sapiens
agacattatttgtaa

SEQ ID NO: 487881 - DNA, 15 bp, Homo sapiens
gacattatttgtaat

SEQ ID NO: 487882 - DNA, 15 bp, Homo sapiens
acattatttgtaatt

SEQ ID NO: 487883 - DNA, 15 bp, Homo sapiens
cattatttgtaattt

SEQ ID NO: 487884 - DNA, 15 bp, Homo sapiens
attatttgtaatttt

SEQ ID NO: 487885 - DNA, 15 bp, Homo sapiens
ttatttgtaatttta

SEQ ID NO: 487886 - DNA, 15 bp, Homo sapiens
tatttgtaattttag

SEQ ID NO: 487887 - DNA, 15 bp, Homo sapiens
atttgtaattttaga

SEQ ID NO: 487888 - DNA, 15 bp, Homo sapiens
tttgtaattttagag

SEQ ID NO: 487889 - DNA, 15 bp, Homo sapiens
ttgtaattttagaga

SEQ ID NO: 487890 - DNA, 15 bp, Homo sapiens
tgtaattttagagag

SEQ ID NO: 487891 - DNA, 15 bp, Homo sapiens
gtaattttagagaga

SEQ ID NO: 487892 - DNA, 15 bp, Homo sapiens
taattttagagagat

SEQ ID NO: 487893 - DNA, 15 bp, Homo sapiens
aattttagagagatt

SEQ ID NO: 487894 - DNA, 15 bp, Homo sapiens
attttagagagattt

SEQ ID NO: 487895 - DNA, 15 bp, Homo sapiens
ttttagagagattta

SEQ ID NO: 487896 - DNA, 15 bp, Homo sapiens
tttagagagatttac

SEQ ID NO: 487897 - DNA, 15 bp, Homo sapiens
ttagagagatttact

SEQ ID NO: 487898 - DNA, 15 bp, Homo sapiens
tagagagatttactc

SEQ ID NO: 487899 - DNA, 15 bp, Homo sapiens
agagagatttactct

SEQ ID NO: 487900 - DNA, 15 bp, Homo sapiens
gagagatttactctc

SEQ ID NO: 487901 - DNA, 15 bp, Homo sapiens
agagatttactctca

SEQ ID NO: 487902 - DNA, 15 bp, Homo sapiens
gagatttactctcaa

SEQ ID NO: 487903 - DNA, 15 bp, Homo sapiens
agatttactctcaaa

SEQ ID NO: 487904 - DNA, 15 bp, Homo sapiens
gatttactctcaaac

SEQ ID NO: 487905 - DNA, 15 bp, Homo sapiens
atttactctcaaact

SEQ ID NO: 487906 - DNA, 15 bp, Homo sapiens
tttactctcaaactg

SEQ ID NO: 487907 - DNA, 15 bp, Homo sapiens
ttactctcaaactga

SEQ ID NO: 487908 - DNA, 15 bp, Homo sapiens
tactctcaaactgat

SEQ ID NO: 487909 - DNA, 15 bp, Homo sapiens
actctcaaactgatt

SEQ ID NO: 487910 - DNA, 15 bp, Homo sapiens
ctctcaaactgattt

SEQ ID NO: 487911 - DNA, 15 bp, Homo sapiens
tctcaaactgatttt

SEQ ID NO: 487912 - DNA, 15 bp, Homo sapiens
ctcaaactgatttta

SEQ ID NO: 487913 - DNA, 15 bp, Homo sapiens
tcaaactgattttaa

SEQ ID NO: 487914 - DNA, 15 bp, Homo sapiens
caaactgattttaaa

SEQ ID NO: 487915 - DNA, 15 bp, Homo sapiens
aaactgattttaaat

SEQ ID NO: 487916 - DNA, 15 bp, Homo sapiens
aactgattttaaatc

SEQ ID NO: 487917 - DNA, 15 bp, Homo sapiens
actgattttaaatcc

SEQ ID NO: 487918 - DNA, 15 bp, Homo sapiens
ctgattttaaatcca

SEQ ID NO: 487919 - DNA, 15 bp, Homo sapiens
tgattttaaatccag

SEQ ID NO: 487920 - DNA, 15 bp, Homo sapiens
gattttaaatccagg

SEQ ID NO: 487921 - DNA, 15 bp, Homo sapiens
attttaaatccaggg

SEQ ID NO: 487922 - DNA, 15 bp, Homo sapiens
ttttaaatccagggc

SEQ ID NO: 487923 - DNA, 15 bp, Homo sapiens
tttaaatccagggca

SEQ ID NO: 487924 - DNA, 15 bp, Homo sapiens
ttaaatccagggcag

SEQ ID NO: 487925 - DNA, 15 bp, Homo sapiens
taaatccagggcagt

SEQ ID NO: 487926 - DNA, 15 bp, Homo sapiens
aaatccagggcagtc

SEQ ID NO: 487927 - DNA, 15 bp, Homo sapiens
aatccagggcagtca

SEQ ID NO: 487928 - DNA, 15 bp, Homo sapiens
atccagggcagtcac

SEQ ID NO: 487929 - DNA, 15 bp, Homo sapiens
tccagggcagtcact

SEQ ID NO: 487930 - DNA, 15 bp, Homo sapiens
ccagggcagtcacta

SEQ ID NO: 487931 - DNA, 15 bp, Homo sapiens
cagggcagtcactaa

SEQ ID NO: 487932 - DNA, 15 bp, Homo sapiens
agggcagtcactaaa

SEQ ID NO: 487933 - DNA, 15 bp, Homo sapiens
gggcagtcactaaaa

SEQ ID NO: 487934 - DNA, 15 bp, Homo sapiens
ggcagtcactaaaat

SEQ ID NO: 487935 - DNA, 15 bp, Homo sapiens
gcagtcactaaaata

SEQ ID NO: 487936 - DNA, 15 bp, Homo sapiens
cagtcactaaaataa

SEQ ID NO: 487937 - DNA, 15 bp, Homo sapiens
agtcactaaaataag

SEQ ID NO: 487938 - DNA, 15 bp, Homo sapiens
gtcactaaaataaga

SEQ ID NO: 487939 - DNA, 15 bp, Homo sapiens
tcactaaaataagaa

SEQ ID NO: 487940 - DNA, 15 bp, Homo sapiens
cactaaaataagaat

SEQ ID NO: 487941 - DNA, 15 bp, Homo sapiens
actaaaataagaatt

SEQ ID NO: 487942 - DNA, 15 bp, Homo sapiens
ctaaaataagaattc

SEQ ID NO: 487943 - DNA, 15 bp, Homo sapiens
taaaataagaattca

SEQ ID NO: 487944 - DNA, 15 bp, Homo sapiens
aaaataagaattcat

SEQ ID NO: 487945 - DNA, 15 bp, Homo sapiens
aaataagaattcatg

SEQ ID NO: 487946 - DNA, 15 bp, Homo sapiens
aataagaattcatgt

SEQ ID NO: 487947 - DNA, 15 bp, Homo sapiens
ataagaattcatgta

SEQ ID NO: 487948 - DNA, 15 bp, Homo sapiens
taagaattcatgtaa

SEQ ID NO: 487949 - DNA, 15 bp, Homo sapiens
aagaattcatgtaaa

SEQ ID NO: 487950 - DNA, 15 bp, Homo sapiens
agaattcatgtaaag

SEQ ID NO: 487951 - DNA, 15 bp, Homo sapiens
gaattcatgtaaagc

SEQ ID NO: 487952 - DNA, 15 bp, Homo sapiens
aattcatgtaaagca

SEQ ID NO: 487953 - DNA, 15 bp, Homo sapiens
attcatgtaaagcat

SEQ ID NO: 487954 - DNA, 15 bp, Homo sapiens
ttcatgtaaagcata

SEQ ID NO: 487955 - DNA, 15 bp, Homo sapiens
tcatgtaaagcatag

SEQ ID NO: 487956 - DNA, 15 bp, Homo sapiens
catgtaaagcatagc

SEQ ID NO: 487957 - DNA, 15 bp, Homo sapiens
atgtaaagcatagcc

SEQ ID NO: 487958 - DNA, 15 bp, Homo sapiens
tgtaaagcatagcct

SEQ ID NO: 487959 - DNA, 15 bp, Homo sapiens
gtaaagcatagcctc

SEQ ID NO: 487960 - DNA, 15 bp, Homo sapiens
taaagcatagcctct

SEQ ID NO: 487961 - DNA, 15 bp, Homo sapiens
aaagcatagcctctt

SEQ ID NO: 487962 - DNA, 15 bp, Homo sapiens
aagcatagcctctta

SEQ ID NO: 487963 - DNA, 15 bp, Homo sapiens
agcatagcctcttat

SEQ ID NO: 487964 - DNA, 15 bp, Homo sapiens
gcatagcctcttatt

SEQ ID NO: 487965 - DNA, 15 bp, Homo sapiens
catagcctcttattt

SEQ ID NO: 487966 - DNA, 15 bp, Homo sapiens
atagcctcttatttt

SEQ ID NO: 487967 - DNA, 15 bp, Homo sapiens
tagcctcttatttta

SEQ ID NO: 487968 - DNA, 15 bp, Homo sapiens
agcctcttattttac

SEQ ID NO: 487969 - DNA, 15 bp, Homo sapiens
gcctcttattttacc

SEQ ID NO: 487970 - DNA, 15 bp, Homo sapiens
cctcttattttaccc

SEQ ID NO: 487971 - DNA, 15 bp, Homo sapiens
ctcttattttaccct

SEQ ID NO: 487972 - DNA, 15 bp, Homo sapiens
tcttattttaccctt

SEQ ID NO: 487973 - DNA, 15 bp, Homo sapiens
cttattttacccttg

SEQ ID NO: 487974 - DNA, 15 bp, Homo sapiens
ttattttacccttgt

SEQ ID NO: 487975 - DNA, 15 bp, Homo sapiens
tattttacccttgtc

SEQ ID NO: 487976 - DNA, 15 bp, Homo sapiens
attttacccttgtct

SEQ ID NO: 487977 - DNA, 15 bp, Homo sapiens
ttttacccttgtctg

SEQ ID NO: 487978 - DNA, 15 bp, Homo sapiens
tttacccttgtctgt

SEQ ID NO: 487979 - DNA, 15 bp, Homo sapiens
ttacccttgtctgtc

SEQ ID NO: 487980 - DNA, 15 bp, Homo sapiens
tacccttgtctgtca

SEQ ID NO: 487981 - DNA, 15 bp, Homo sapiens
acccttgtctgtcat

SEQ ID NO: 487982 - DNA, 15 bp, Homo sapiens
cccttgtctgtcatc

SEQ ID NO: 487983 - DNA, 15 bp, Homo sapiens
ccttgtctgtcatct

SEQ ID NO: 487984 - DNA, 15 bp, Homo sapiens
cttgtctgtcatctc

SEQ ID NO: 487985 - DNA, 15 bp, Homo sapiens
ttgtctgtcatctcc

SEQ ID NO: 487986 - DNA, 15 bp, Homo sapiens
tgtctgtcatctcct

SEQ ID NO: 487987 - DNA, 15 bp, Homo sapiens
gtctgtcatctcctt

SEQ ID NO: 487988 - DNA, 15 bp, Homo sapiens
tctgtcatctcctta

SEQ ID NO: 487989 - DNA, 15 bp, Homo sapiens
ctgtcatctccttag

SEQ ID NO: 487990 - DNA, 15 bp, Homo sapiens
tgtcatctccttaga

SEQ ID NO: 487991 - DNA, 15 bp, Homo sapiens
gtcatctccttagaa

SEQ ID NO: 487992 - DNA, 15 bp, Homo sapiens
tcatctccttagaaa

SEQ ID NO: 487993 - DNA, 15 bp, Homo sapiens
catctccttagaaaa

SEQ ID NO: 487994 - DNA, 15 bp, Homo sapiens
atctccttagaaaat

SEQ ID NO: 487995 - DNA, 15 bp, Homo sapiens
tctccttagaaaatg

SEQ ID NO: 487996 - DNA, 15 bp, Homo sapiens
ctccttagaaaatgc

SEQ ID NO: 487997 - DNA, 15 bp, Homo sapiens
tccttagaaaatgcc

SEQ ID NO: 487998 - DNA, 15 bp, Homo sapiens
ccttagaaaatgcca

SEQ ID NO: 487999 - DNA, 15 bp, Homo sapiens
cttagaaaatgccat

SEQ ID NO: 488000 - DNA, 15 bp, Homo sapiens
ttagaaaatgccatc

SEQ ID NO: 488001 - DNA, 15 bp, Homo sapiens
tagaaaatgccatcc

SEQ ID NO: 488002 - DNA, 15 bp, Homo sapiens
agaaaatgccatccc

SEQ ID NO: 488003 - DNA, 15 bp, Homo sapiens
gaaaatgccatccca

SEQ ID NO: 488004 - DNA, 15 bp, Homo sapiens
aaaatgccatcccag

SEQ ID NO: 488005 - DNA, 15 bp, Homo sapiens
aaatgccatcccagg

SEQ ID NO: 488006 - DNA, 15 bp, Homo sapiens
aatgccatcccaggc

SEQ ID NO: 488007 - DNA, 15 bp, Homo sapiens
atgccatcccaggct

SEQ ID NO: 488008 - DNA, 15 bp, Homo sapiens
tgccatcccaggctg

SEQ ID NO: 488009 - DNA, 15 bp, Homo sapiens
gccatcccaggctgg

SEQ ID NO: 488010 - DNA, 15 bp, Homo sapiens
ccatcccaggctggg

SEQ ID NO: 488011 - DNA, 15 bp, Homo sapiens
catcccaggctgggc

SEQ ID NO: 488012 - DNA, 15 bp, Homo sapiens
atcccaggctgggca

SEQ ID NO: 488013 - DNA, 15 bp, Homo sapiens
tcccaggctgggcac

SEQ ID NO: 488014 - DNA, 15 bp, Homo sapiens
cccaggctgggcacg

SEQ ID NO: 488015 - DNA, 15 bp, Homo sapiens
ccaggctgggcacgg

SEQ ID NO: 488016 - DNA, 15 bp, Homo sapiens
caggctgggcacggt

SEQ ID NO: 488017 - DNA, 15 bp, Homo sapiens
aggctgggcacggtg

SEQ ID NO: 488018 - DNA, 15 bp, Homo sapiens
agcactttgggaggg

SEQ ID NO: 488019 - DNA, 15 bp, Homo sapiens
gcactttgggagggc

SEQ ID NO: 488020 - DNA, 15 bp, Homo sapiens
cactttgggagggcg

SEQ ID NO: 488021 - DNA, 15 bp, Homo sapiens
actttgggagggcga

SEQ ID NO: 488022 - DNA, 15 bp, Homo sapiens
ctttgggagggcgag

SEQ ID NO: 488023 - DNA, 15 bp, Homo sapiens
tttgggagggcgagg

SEQ ID NO: 488024 - DNA, 15 bp, Homo sapiens
ttgggagggcgaggc

SEQ ID NO: 488025 - DNA, 15 bp, Homo sapiens
tgggagggcgaggca

SEQ ID NO: 488026 - DNA, 15 bp, Homo sapiens
gggagggcgaggcag

SEQ ID NO: 488027 - DNA, 15 bp, Homo sapiens
ggagggcgaggcagg

SEQ ID NO: 488028 - DNA, 15 bp, Homo sapiens
gagggcgaggcaggt

SEQ ID NO: 488029 - DNA, 15 bp, Homo sapiens
agggcgaggcaggtg

SEQ ID NO: 488030 - DNA, 15 bp, Homo sapiens
gggcgaggcaggtgg

SEQ ID NO: 488031 - DNA, 15 bp, Homo sapiens
ggcgaggcaggtgga

SEQ ID NO: 488032 - DNA, 15 bp, Homo sapiens
gcgaggcaggtggat

SEQ ID NO: 488033 - DNA, 15 bp, Homo sapiens
ggcaggtggatcatg

SEQ ID NO: 488034 - DNA, 15 bp, Homo sapiens
gcaggtggatcatga

SEQ ID NO: 488035 - DNA, 15 bp, Homo sapiens
caggtggatcatgag

SEQ ID NO: 488036 - DNA, 15 bp, Homo sapiens
aggtggatcatgaga

SEQ ID NO: 488037 - DNA, 15 bp, Homo sapiens
ggtggatcatgagat

SEQ ID NO: 488038 - DNA, 15 bp, Homo sapiens
gtggatcatgagatc

SEQ ID NO: 488039 - DNA, 15 bp, Homo sapiens
tggatcatgagatca

SEQ ID NO: 488040 - DNA, 15 bp, Homo sapiens
ggatcatgagatcag

SEQ ID NO: 488041 - DNA, 15 bp, Homo sapiens
gatcatgagatcagg

SEQ ID NO: 488042 - DNA, 15 bp, Homo sapiens
atcatgagatcagga

SEQ ID NO: 488043 - DNA, 15 bp, Homo sapiens
tcatgagatcaggag

SEQ ID NO: 488044 - DNA, 15 bp, Homo sapiens
catgagatcaggagt

SEQ ID NO: 488045 - DNA, 15 bp, Homo sapiens
atgagatcaggagtt

SEQ ID NO: 488046 - DNA, 15 bp, Homo sapiens
tgagatcaggagttc

SEQ ID NO: 488047 - DNA, 15 bp, Homo sapiens
gagatcaggagttcg

SEQ ID NO: 488048 - DNA, 15 bp, Homo sapiens
agatcaggagttcga

SEQ ID NO: 488049 - DNA, 15 bp, Homo sapiens
gatcaggagttcgag

SEQ ID NO: 488050 - DNA, 15 bp, Homo sapiens
atcaggagttcgaga

SEQ ID NO: 488051 - DNA, 15 bp, Homo sapiens
gagttcgagaccagt

SEQ ID NO: 488052 - DNA, 15 bp, Homo sapiens
agttcgagaccagtc

SEQ ID NO: 488053 - DNA, 15 bp, Homo sapiens
gttcgagaccagtct

SEQ ID NO: 488054 - DNA, 15 bp, Homo sapiens
ttcgagaccagtctg

SEQ ID NO: 488055 - DNA, 15 bp, Homo sapiens
tcgagaccagtctga

SEQ ID NO: 488056 - DNA, 15 bp, Homo sapiens
cgagaccagtctgac

SEQ ID NO: 488057 - DNA, 15 bp, Homo sapiens
gagaccagtctgacc

SEQ ID NO: 488058 - DNA, 15 bp, Homo sapiens
agaccagtctgacca

SEQ ID NO: 488059 - DNA, 15 bp, Homo sapiens
gaccagtctgaccaa

SEQ ID NO: 488060 - DNA, 15 bp, Homo sapiens
accagtctgaccaac

SEQ ID NO: 488061 - DNA, 15 bp, Homo sapiens
ccagtctgaccaaca

SEQ ID NO: 488062 - DNA, 15 bp, Homo sapiens
cagtctgaccaacat

SEQ ID NO: 488063 - DNA, 15 bp, Homo sapiens
agtctgaccaacatg

SEQ ID NO: 488064 - DNA, 15 bp, Homo sapiens
gtctgaccaacatgg

SEQ ID NO: 488065 - DNA, 15 bp, Homo sapiens
tctgaccaacatggt

SEQ ID NO: 488066 - DNA, 15 bp, Homo sapiens
ggtgaaaccctgtcg

SEQ ID NO: 488067 - DNA, 15 bp, Homo sapiens
gtgaaaccctgtcgc

SEQ ID NO: 488068 - DNA, 15 bp, Homo sapiens
tgaaaccctgtcgct

SEQ ID NO: 488069 - DNA, 15 bp, Homo sapiens
gaaaccctgtcgcta

SEQ ID NO: 488070 - DNA, 15 bp, Homo sapiens
aaaccctgtcgctac

SEQ ID NO: 488071 - DNA, 15 bp, Homo sapiens
aaccctgtcgctact

SEQ ID NO: 488072 - DNA, 15 bp, Homo sapiens
accctgtcgctacta

SEQ ID NO: 488073 - DNA, 15 bp, Homo sapiens
ccctgtcgctactaa

SEQ ID NO: 488074 - DNA, 15 bp, Homo sapiens
cctgtcgctactaaa

SEQ ID NO: 488075 - DNA, 15 bp, Homo sapiens
ctgtcgctactaaaa

SEQ ID NO: 488076 - DNA, 15 bp, Homo sapiens
tgtcgctactaaaaa

SEQ ID NO: 488077 - DNA, 15 bp, Homo sapiens
gtcgctactaaaaat

SEQ ID NO: 488078 - DNA, 15 bp, Homo sapiens
tacaaaaagtagccg

SEQ ID NO: 488079 - DNA, 15 bp, Homo sapiens
acaaaaagtagccgg

SEQ ID NO: 488080 - DNA, 15 bp, Homo sapiens
caaaaagtagccggg

SEQ ID NO: 488081 - DNA, 15 bp, Homo sapiens
aaaaagtagccgggc

SEQ ID NO: 488082 - DNA, 15 bp, Homo sapiens
aaaagtagccgggca

SEQ ID NO: 488083 - DNA, 15 bp, Homo sapiens
aaagtagccgggcat

SEQ ID NO: 488084 - DNA, 15 bp, Homo sapiens
aagtagccgggcatg

SEQ ID NO: 488085 - DNA, 15 bp, Homo sapiens
agtagccgggcatgg

SEQ ID NO: 488086 - DNA, 15 bp, Homo sapiens
gtagccgggcatggt

SEQ ID NO: 488087 - DNA, 15 bp, Homo sapiens
gggcatggtggcatg

SEQ ID NO: 488088 - DNA, 15 bp, Homo sapiens
gcatggtggcatgca

SEQ ID NO: 488089 - DNA, 15 bp, Homo sapiens
catggtggcatgcac

SEQ ID NO: 488090 - DNA, 15 bp, Homo sapiens
atggtggcatgcact

SEQ ID NO: 488091 - DNA, 15 bp, Homo sapiens
tggtggcatgcactt

SEQ ID NO: 488092 - DNA, 15 bp, Homo sapiens
ggtggcatgcacttg

SEQ ID NO: 488093 - DNA, 15 bp, Homo sapiens
gtggcatgcacttgt

SEQ ID NO: 488094 - DNA, 15 bp, Homo sapiens
tggcatgcacttgta

SEQ ID NO: 488095 - DNA, 15 bp, Homo sapiens
ggcatgcacttgtaa

SEQ ID NO: 488096 - DNA, 15 bp, Homo sapiens
gcatgcacttgtaat

SEQ ID NO: 488097 - DNA, 15 bp, Homo sapiens
catgcacttgtaatc

SEQ ID NO: 488098 - DNA, 15 bp, Homo sapiens
atgcacttgtaatcc

SEQ ID NO: 488099 - DNA, 15 bp, Homo sapiens
tgcacttgtaatccc

SEQ ID NO: 488100 - DNA, 15 bp, Homo sapiens
gcacttgtaatccca

SEQ ID NO: 488101 - DNA, 15 bp, Homo sapiens
ttgtaatcccagcaa

SEQ ID NO: 488102 - DNA, 15 bp, Homo sapiens
tgtaatcccagcaac

SEQ ID NO: 488103 - DNA, 15 bp, Homo sapiens
gtaatcccagcaact

SEQ ID NO: 488104 - DNA, 15 bp, Homo sapiens
taatcccagcaactc

SEQ ID NO: 488105 - DNA, 15 bp, Homo sapiens
aatcccagcaactca

SEQ ID NO: 488106 - DNA, 15 bp, Homo sapiens
atcccagcaactcag

SEQ ID NO: 488107 - DNA, 15 bp, Homo sapiens
tcccagcaactcagg

SEQ ID NO: 488108 - DNA, 15 bp, Homo sapiens
cccagcaactcagga

SEQ ID NO: 488109 - DNA, 15 bp, Homo sapiens
ccagcaactcaggag

SEQ ID NO: 488110 - DNA, 15 bp, Homo sapiens
cagcaactcaggagg

SEQ ID NO: 488111 - DNA, 15 bp, Homo sapiens
agcaactcaggaggt

SEQ ID NO: 488112 - DNA, 15 bp, Homo sapiens
gcaactcaggaggtt

SEQ ID NO: 488113 - DNA, 15 bp, Homo sapiens
caactcaggaggttg

SEQ ID NO: 488114 - DNA, 15 bp, Homo sapiens
tgaacctgggaggta

SEQ ID NO: 488115 - DNA, 15 bp, Homo sapiens
gaacctgggaggtag

SEQ ID NO: 488116 - DNA, 15 bp, Homo sapiens
aacctgggaggtaga

SEQ ID NO: 488117 - DNA, 15 bp, Homo sapiens
acctgggaggtagag

SEQ ID NO: 488118 - DNA, 15 bp, Homo sapiens
cctgggaggtagagg

SEQ ID NO: 488119 - DNA, 15 bp, Homo sapiens
ctgggaggtagaggt

SEQ ID NO: 488120 - DNA, 15 bp, Homo sapiens
gggaggtagaggttg

SEQ ID NO: 488121 - DNA, 15 bp, Homo sapiens
ggaggtagaggttgc

SEQ ID NO: 488122 - DNA, 15 bp, Homo sapiens
gaggtagaggttgca

SEQ ID NO: 488123 - DNA, 15 bp, Homo sapiens
aggtagaggttgcaa

SEQ ID NO: 488124 - DNA, 15 bp, Homo sapiens
ggtagaggttgcaat

SEQ ID NO: 488125 - DNA, 15 bp, Homo sapiens
gtagaggttgcaatg

SEQ ID NO: 488126 - DNA, 15 bp, Homo sapiens
tagaggttgcaatga

SEQ ID NO: 488127 - DNA, 15 bp, Homo sapiens
agaggttgcaatgag

SEQ ID NO: 488128 - DNA, 15 bp, Homo sapiens
aatgagccgagatcg

SEQ ID NO: 488129 - DNA, 15 bp, Homo sapiens
atgagccgagatcgt

SEQ ID NO: 488130 - DNA, 15 bp, Homo sapiens
cgagatcgtgccacc

SEQ ID NO: 488131 - DNA, 15 bp, Homo sapiens
gagatcgtgccaccg

SEQ ID NO: 488132 - DNA, 15 bp, Homo sapiens
agatcgtgccaccgc

SEQ ID NO: 488133 - DNA, 15 bp, Homo sapiens
gatcgtgccaccgca

SEQ ID NO: 488134 - DNA, 15 bp, Homo sapiens
atcgtgccaccgcac

SEQ ID NO: 488135 - DNA, 15 bp, Homo sapiens
tcgtgccaccgcact

SEQ ID NO: 488136 - DNA, 15 bp, Homo sapiens
cgtgccaccgcactc

SEQ ID NO: 488137 - DNA, 15 bp, Homo sapiens
agcctgggagacagc

SEQ ID NO: 488138 - DNA, 15 bp, Homo sapiens
gcctgggagacagcg

SEQ ID NO: 488139 - DNA, 15 bp, Homo sapiens
cctgggagacagcgt

SEQ ID NO: 488140 - DNA, 15 bp, Homo sapiens
ctgggagacagcgtg

SEQ ID NO: 488141 - DNA, 15 bp, Homo sapiens
tgggagacagcgtga

SEQ ID NO: 488142 - DNA, 15 bp, Homo sapiens
gggagacagcgtgag

SEQ ID NO: 488143 - DNA, 15 bp, Homo sapiens
ggagacagcgtgaga

SEQ ID NO: 488144 - DNA, 15 bp, Homo sapiens
gagacagcgtgagac

SEQ ID NO: 488145 - DNA, 15 bp, Homo sapiens
agacagcgtgagact

SEQ ID NO: 488146 - DNA, 15 bp, Homo sapiens
gacagcgtgagactt

SEQ ID NO: 488147 - DNA, 15 bp, Homo sapiens
acagcgtgagacttc

SEQ ID NO: 488148 - DNA, 15 bp, Homo sapiens
cagcgtgagacttcc

SEQ ID NO: 488149 - DNA, 15 bp, Homo sapiens
agcgtgagacttcct

SEQ ID NO: 488150 - DNA, 15 bp, Homo sapiens
gcgtgagacttcctc

SEQ ID NO: 488151 - DNA, 15 bp, Homo sapiens
cgtgagacttcctct

SEQ ID NO: 488152 - DNA, 15 bp, Homo sapiens
gtgagacttcctctc

SEQ ID NO: 488153 - DNA, 15 bp, Homo sapiens
tgagacttcctctcc

SEQ ID NO: 488154 - DNA, 15 bp, Homo sapiens
gagacttcctctcca

SEQ ID NO: 488155 - DNA, 15 bp, Homo sapiens
agacttcctctccaa

SEQ ID NO: 488156 - DNA, 15 bp, Homo sapiens
gacttcctctccaaa

SEQ ID NO: 488157 - DNA, 15 bp, Homo sapiens
acttcctctccaaaa

SEQ ID NO: 488158 - DNA, 15 bp, Homo sapiens
cttcctctccaaaaa

SEQ ID NO: 488159 - DNA, 15 bp, Homo sapiens
ttcctctccaaaaaa

SEQ ID NO: 488160 - DNA, 15 bp, Homo sapiens
tcctctccaaaaaaa

SEQ ID NO: 488161 - DNA, 15 bp, Homo sapiens
cctctccaaaaaaaa

SEQ ID NO: 488162 - DNA, 15 bp, Homo sapiens
ctctccaaaaaaaaa

SEQ ID NO: 488163 - DNA, 15 bp, Homo sapiens
ctccaaaaaaaaaaa

SEQ ID NO: 488164 - DNA, 15 bp, Homo sapiens
tccaaaaaaaaaaaa

SEQ ID NO: 488165 - DNA, 15 bp, Homo sapiens
aaaaaaaaaaaagcc

SEQ ID NO: 488166 - DNA, 15 bp, Homo sapiens
aaaaaaaaaagccat

SEQ ID NO: 488167 - DNA, 15 bp, Homo sapiens
aaaaaaaaagccatc

SEQ ID NO: 488168 - DNA, 15 bp, Homo sapiens
aaaaaaaagccatcc

SEQ ID NO: 488169 - DNA, 15 bp, Homo sapiens
aaaaaaagccatccg

SEQ ID NO: 488170 - DNA, 15 bp, Homo sapiens
aaaaaagccatccga

SEQ ID NO: 488171 - DNA, 15 bp, Homo sapiens
aaaaagccatccgaa

SEQ ID NO: 488172 - DNA, 15 bp, Homo sapiens
aaaagccatccgaaa

SEQ ID NO: 488173 - DNA, 15 bp, Homo sapiens
aaagccatccgaaat

SEQ ID NO: 488174 - DNA, 15 bp, Homo sapiens
aagccatccgaaatg

SEQ ID NO: 488175 - DNA, 15 bp, Homo sapiens
agccatccgaaatga

SEQ ID NO: 488176 - DNA, 15 bp, Homo sapiens
gccatccgaaatgat

SEQ ID NO: 488177 - DNA, 15 bp, Homo sapiens
ccatccgaaatgatg

SEQ ID NO: 488178 - DNA, 15 bp, Homo sapiens
catccgaaatgatga

SEQ ID NO: 488179 - DNA, 15 bp, Homo sapiens
atccgaaatgatgaa

SEQ ID NO: 488180 - DNA, 15 bp, Homo sapiens
tccgaaatgatgaaa

SEQ ID NO: 488181 - DNA, 15 bp, Homo sapiens
ccgaaatgatgaaaa

SEQ ID NO: 488182 - DNA, 15 bp, Homo sapiens
cgaaatgatgaaaaa

SEQ ID NO: 488183 - DNA, 15 bp, Homo sapiens
gaaatgatgaaaaag

SEQ ID NO: 488184 - DNA, 15 bp, Homo sapiens
aaatgatgaaaaaga

SEQ ID NO: 488185 - DNA, 15 bp, Homo sapiens
aatgatgaaaaagag

SEQ ID NO: 488186 - DNA, 15 bp, Homo sapiens
atgatgaaaaagaga

SEQ ID NO: 488187 - DNA, 15 bp, Homo sapiens
tgatgaaaaagagat

SEQ ID NO: 488188 - DNA, 15 bp, Homo sapiens
gatgaaaaagagatt

SEQ ID NO: 488189 - DNA, 15 bp, Homo sapiens
gaaaaagagattatc

SEQ ID NO: 488190 - DNA, 15 bp, Homo sapiens
aaaaagagattatca

SEQ ID NO: 488191 - DNA, 15 bp, Homo sapiens
aaaagagattatcaa

SEQ ID NO: 488192 - DNA, 15 bp, Homo sapiens
aaagagattatcaat

SEQ ID NO: 488193 - DNA, 15 bp, Homo sapiens
aagagattatcaatt

SEQ ID NO: 488194 - DNA, 15 bp, Homo sapiens
agagattatcaatta

SEQ ID NO: 488195 - DNA, 15 bp, Homo sapiens
gagattatcaattat

SEQ ID NO: 488196 - DNA, 15 bp, Homo sapiens
agattatcaattatc

SEQ ID NO: 488197 - DNA, 15 bp, Homo sapiens
gattatcaattatca

SEQ ID NO: 488198 - DNA, 15 bp, Homo sapiens
attatcaattatcag

SEQ ID NO: 488199 - DNA, 15 bp, Homo sapiens
ttatcaattatcagg

SEQ ID NO: 488200 - DNA, 15 bp, Homo sapiens
tatcaattatcagga

SEQ ID NO: 488201 - DNA, 15 bp, Homo sapiens
atcaattatcaggag

SEQ ID NO: 488202 - DNA, 15 bp, Homo sapiens
tcaattatcaggagt

SEQ ID NO: 488203 - DNA, 15 bp, Homo sapiens
caattatcaggagtg

SEQ ID NO: 488204 - DNA, 15 bp, Homo sapiens
aattatcaggagtgt

SEQ ID NO: 488205 - DNA, 15 bp, Homo sapiens
attatcaggagtgta

SEQ ID NO: 488206 - DNA, 15 bp, Homo sapiens
ttatcaggagtgtag

SEQ ID NO: 488207 - DNA, 15 bp, Homo sapiens
tatcaggagtgtagg

SEQ ID NO: 488208 - DNA, 15 bp, Homo sapiens
atcaggagtgtaggt

SEQ ID NO: 488209 - DNA, 15 bp, Homo sapiens
tcaggagtgtaggta

SEQ ID NO: 488210 - DNA, 15 bp, Homo sapiens
caggagtgtaggtaa

SEQ ID NO: 488211 - DNA, 15 bp, Homo sapiens
aggagtgtaggtaaa

SEQ ID NO: 488212 - DNA, 15 bp, Homo sapiens
ggagtgtaggtaaat

SEQ ID NO: 488213 - DNA, 15 bp, Homo sapiens
gagtgtaggtaaata

SEQ ID NO: 488214 - DNA, 15 bp, Homo sapiens
agtgtaggtaaataa

SEQ ID NO: 488215 - DNA, 15 bp, Homo sapiens
gtgtaggtaaataag

SEQ ID NO: 488216 - DNA, 15 bp, Homo sapiens
tgtaggtaaataaga

SEQ ID NO: 488217 - DNA, 15 bp, Homo sapiens
gtaggtaaataagat

SEQ ID NO: 488218 - DNA, 15 bp, Homo sapiens
taggtaaataagata

SEQ ID NO: 488219 - DNA, 15 bp, Homo sapiens
aggtaaataagatat

SEQ ID NO: 488220 - DNA, 15 bp, Homo sapiens
ggtaaataagatata

SEQ ID NO: 488221 - DNA, 15 bp, Homo sapiens
gtaaataagatatat

SEQ ID NO: 488222 - DNA, 15 bp, Homo sapiens
taaataagatatatt

SEQ ID NO: 488223 - DNA, 15 bp, Homo sapiens
aaataagatatattg

SEQ ID NO: 488224 - DNA, 15 bp, Homo sapiens
aataagatatattga

SEQ ID NO: 488225 - DNA, 15 bp, Homo sapiens
ataagatatattgac

SEQ ID NO: 488226 - DNA, 15 bp, Homo sapiens
taagatatattgact

SEQ ID NO: 488227 - DNA, 15 bp, Homo sapiens
aagatatattgactt

SEQ ID NO: 488228 - DNA, 15 bp, Homo sapiens
agatatattgacttc

SEQ ID NO: 488229 - DNA, 15 bp, Homo sapiens
gatatattgacttca

SEQ ID NO: 488230 - DNA, 15 bp, Homo sapiens
atatattgacttcat

SEQ ID NO: 488231 - DNA, 15 bp, Homo sapiens
tatattgacttcatt

SEQ ID NO: 488232 - DNA, 15 bp, Homo sapiens
atattgacttcattt

SEQ ID NO: 488233 - DNA, 15 bp, Homo sapiens
tattgacttcattta

SEQ ID NO: 488234 - DNA, 15 bp, Homo sapiens
attgacttcatttaa

SEQ ID NO: 488235 - DNA, 15 bp, Homo sapiens
ttgacttcatttaaa

SEQ ID NO: 488236 - DNA, 15 bp, Homo sapiens
tgacttcatttaaag

SEQ ID NO: 488237 - DNA, 15 bp, Homo sapiens
gacttcatttaaaga

SEQ ID NO: 488238 - DNA, 15 bp, Homo sapiens
acttcatttaaagat

SEQ ID NO: 488239 - DNA, 15 bp, Homo sapiens
cttcatttaaagatt

SEQ ID NO: 488240 - DNA, 15 bp, Homo sapiens
ttcatttaaagatta

SEQ ID NO: 488241 - DNA, 15 bp, Homo sapiens
tcatttaaagattat

SEQ ID NO: 488242 - DNA, 15 bp, Homo sapiens
catttaaagattatt

SEQ ID NO: 488243 - DNA, 15 bp, Homo sapiens
atttaaagattatta

SEQ ID NO: 488244 - DNA, 15 bp, Homo sapiens
tttaaagattattat

SEQ ID NO: 488245 - DNA, 15 bp, Homo sapiens
ttaaagattattatt

SEQ ID NO: 488246 - DNA, 15 bp, Homo sapiens
taaagattattattt

SEQ ID NO: 488247 - DNA, 15 bp, Homo sapiens
aaagattattattta

SEQ ID NO: 488248 - DNA, 15 bp, Homo sapiens
aagattattatttac

SEQ ID NO: 488249 - DNA, 15 bp, Homo sapiens
agattattatttact

SEQ ID NO: 488250 - DNA, 15 bp, Homo sapiens
gattattatttactg

SEQ ID NO: 488251 - DNA, 15 bp, Homo sapiens
attattatttactgt

SEQ ID NO: 488252 - DNA, 15 bp, Homo sapiens
ttattatttactgta

SEQ ID NO: 488253 - DNA, 15 bp, Homo sapiens
tattatttactgtat

SEQ ID NO: 488254 - DNA, 15 bp, Homo sapiens
attatttactgtata

SEQ ID NO: 488255 - DNA, 15 bp, Homo sapiens
ttatttactgtatag

SEQ ID NO: 488256 - DNA, 15 bp, Homo sapiens
tatttactgtataga

SEQ ID NO: 488257 - DNA, 15 bp, Homo sapiens
atttactgtatagaa

SEQ ID NO: 488258 - DNA, 15 bp, Homo sapiens
tttactgtatagaac

SEQ ID NO: 488259 - DNA, 15 bp, Homo sapiens
ttactgtatagaact

SEQ ID NO: 488260 - DNA, 15 bp, Homo sapiens
tactgtatagaactt

SEQ ID NO: 488261 - DNA, 15 bp, Homo sapiens
actgtatagaacttt

SEQ ID NO: 488262 - DNA, 15 bp, Homo sapiens
ctgtatagaactttg

SEQ ID NO: 488263 - DNA, 15 bp, Homo sapiens
tgtatagaactttgt

SEQ ID NO: 488264 - DNA, 15 bp, Homo sapiens
gtatagaactttgta

SEQ ID NO: 488265 - DNA, 15 bp, Homo sapiens
tatagaactttgtaa

SEQ ID NO: 488266 - DNA, 15 bp, Homo sapiens
atagaactttgtaat

SEQ ID NO: 488267 - DNA, 15 bp, Homo sapiens
tagaactttgtaatt

SEQ ID NO: 488268 - DNA, 15 bp, Homo sapiens
agaactttgtaattt

SEQ ID NO: 488269 - DNA, 15 bp, Homo sapiens
gaactttgtaatttt

SEQ ID NO: 488270 - DNA, 15 bp, Homo sapiens
aactttgtaattttt

SEQ ID NO: 488271 - DNA, 15 bp, Homo sapiens
actttgtaattttta

SEQ ID NO: 488272 - DNA, 15 bp, Homo sapiens
ctttgtaatttttaa

SEQ ID NO: 488273 - DNA, 15 bp, Homo sapiens
tttgtaatttttaaa

SEQ ID NO: 488274 - DNA, 15 bp, Homo sapiens
ttgtaatttttaaaa

SEQ ID NO: 488275 - DNA, 15 bp, Homo sapiens
tgtaatttttaaaat

SEQ ID NO: 488276 - DNA, 15 bp, Homo sapiens
gtaatttttaaaata

SEQ ID NO: 488277 - DNA, 15 bp, Homo sapiens
taatttttaaaatac

SEQ ID NO: 488278 - DNA, 15 bp, Homo sapiens
aatttttaaaatacc

SEQ ID NO: 488279 - DNA, 15 bp, Homo sapiens
atttttaaaatacca

SEQ ID NO: 488280 - DNA, 15 bp, Homo sapiens
tttttaaaataccat

SEQ ID NO: 488281 - DNA, 15 bp, Homo sapiens
ttttaaaataccatc

SEQ ID NO: 488282 - DNA, 15 bp, Homo sapiens
tttaaaataccatca

SEQ ID NO: 488283 - DNA, 15 bp, Homo sapiens
ttaaaataccatcat

SEQ ID NO: 488284 - DNA, 15 bp, Homo sapiens
taaaataccatcatt

SEQ ID NO: 488285 - DNA, 15 bp, Homo sapiens
aaaataccatcatta

SEQ ID NO: 488286 - DNA, 15 bp, Homo sapiens
aaataccatcattag

SEQ ID NO: 488287 - DNA, 15 bp, Homo sapiens
aataccatcattagc

SEQ ID NO: 488288 - DNA, 15 bp, Homo sapiens
ataccatcattagca

SEQ ID NO: 488289 - DNA, 15 bp, Homo sapiens
taccatcattagcag

SEQ ID NO: 488290 - DNA, 15 bp, Homo sapiens
accatcattagcaga

SEQ ID NO: 488291 - DNA, 15 bp, Homo sapiens
ccatcattagcagaa

SEQ ID NO: 488292 - DNA, 15 bp, Homo sapiens
catcattagcagaat

SEQ ID NO: 488293 - DNA, 15 bp, Homo sapiens
atcattagcagaatg

SEQ ID NO: 488294 - DNA, 15 bp, Homo sapiens
tcattagcagaatgt

SEQ ID NO: 488295 - DNA, 15 bp, Homo sapiens
cattagcagaatgtg

SEQ ID NO: 488296 - DNA, 15 bp, Homo sapiens
attagcagaatgtga

SEQ ID NO: 488297 - DNA, 15 bp, Homo sapiens
ttagcagaatgtgaa

SEQ ID NO: 488298 - DNA, 15 bp, Homo sapiens
tagcagaatgtgaaa

SEQ ID NO: 488299 - DNA, 15 bp, Homo sapiens
agcagaatgtgaaaa

SEQ ID NO: 488300 - DNA, 15 bp, Homo sapiens
gcagaatgtgaaaac

SEQ ID NO: 488301 - DNA, 15 bp, Homo sapiens
cagaatgtgaaaaca

SEQ ID NO: 488302 - DNA, 15 bp, Homo sapiens
agaatgtgaaaacag

SEQ ID NO: 488303 - DNA, 15 bp, Homo sapiens
gaatgtgaaaacagc

SEQ ID NO: 488304 - DNA, 15 bp, Homo sapiens
aatgtgaaaacagct

SEQ ID NO: 488305 - DNA, 15 bp, Homo sapiens
atgtgaaaacagcta

SEQ ID NO: 488306 - DNA, 15 bp, Homo sapiens
tgtgaaaacagctat

SEQ ID NO: 488307 - DNA, 15 bp, Homo sapiens
gtgaaaacagctatt

SEQ ID NO: 488308 - DNA, 15 bp, Homo sapiens
tgaaaacagctattt

SEQ ID NO: 488309 - DNA, 15 bp, Homo sapiens
gaaaacagctattta

SEQ ID NO: 488310 - DNA, 15 bp, Homo sapiens
aaaacagctatttaa

SEQ ID NO: 488311 - DNA, 15 bp, Homo sapiens
aaacagctatttaaa

SEQ ID NO: 488312 - DNA, 15 bp, Homo sapiens
aacagctatttaaaa

SEQ ID NO: 488313 - DNA, 15 bp, Homo sapiens
acagctatttaaaat

SEQ ID NO: 488314 - DNA, 15 bp, Homo sapiens
cagctatttaaaata

SEQ ID NO: 488315 - DNA, 15 bp, Homo sapiens
agctatttaaaatat

SEQ ID NO: 488316 - DNA, 15 bp, Homo sapiens
gctatttaaaatata

SEQ ID NO: 488317 - DNA, 15 bp, Homo sapiens
ctatttaaaatatat

SEQ ID NO: 488318 - DNA, 15 bp, Homo sapiens
tatttaaaatatatt

SEQ ID NO: 488319 - DNA, 15 bp, Homo sapiens
atttaaaatatattt

SEQ ID NO: 488320 - DNA, 15 bp, Homo sapiens
tttaaaatatatttc

SEQ ID NO: 488321 - DNA, 15 bp, Homo sapiens
ttaaaatatatttct

SEQ ID NO: 488322 - DNA, 15 bp, Homo sapiens
taaaatatatttctg

SEQ ID NO: 488323 - DNA, 15 bp, Homo sapiens
aaaatatatttctgg

SEQ ID NO: 488324 - DNA, 15 bp, Homo sapiens
aaatatatttctggc

SEQ ID NO: 488325 - DNA, 15 bp, Homo sapiens
aatatatttctggcc

SEQ ID NO: 488326 - DNA, 15 bp, Homo sapiens
atatatttctggccc

SEQ ID NO: 488327 - DNA, 15 bp, Homo sapiens
tatatttctggccca

SEQ ID NO: 488328 - DNA, 15 bp, Homo sapiens
atatttctggcccag

SEQ ID NO: 488329 - DNA, 15 bp, Homo sapiens
tatttctggcccagg

SEQ ID NO: 488330 - DNA, 15 bp, Homo sapiens
atttctggcccaggt

SEQ ID NO: 488331 - DNA, 15 bp, Homo sapiens
tttctggcccaggtg

SEQ ID NO: 488332 - DNA, 15 bp, Homo sapiens
ttctggcccaggtgc

SEQ ID NO: 488333 - DNA, 15 bp, Homo sapiens
tctggcccaggtgcg

SEQ ID NO: 488334 - DNA, 15 bp, Homo sapiens
ctggcccaggtgcgg

SEQ ID NO: 488335 - DNA, 15 bp, Homo sapiens
tggcccaggtgcggt

SEQ ID NO: 488336 - DNA, 15 bp, Homo sapiens
ggcccaggtgcggtg

SEQ ID NO: 488337 - DNA, 15 bp, Homo sapiens
gcccaggtgcggtgg

SEQ ID NO: 488338 - DNA, 15 bp, Homo sapiens
cccaggtgcggtggc

SEQ ID NO: 488339 - DNA, 15 bp, Homo sapiens
ccaggtgcggtggct

SEQ ID NO: 488340 - DNA, 15 bp, Homo sapiens
caggtgcggtggctc

SEQ ID NO: 488341 - DNA, 15 bp, Homo sapiens
aggtgcggtggctca

SEQ ID NO: 488342 - DNA, 15 bp, Homo sapiens
ctcatgcctgtaatt

SEQ ID NO: 488343 - DNA, 15 bp, Homo sapiens
tcatgcctgtaattc

SEQ ID NO: 488344 - DNA, 15 bp, Homo sapiens
cctgtaattccagca

SEQ ID NO: 488345 - DNA, 15 bp, Homo sapiens
ctgtaattccagcat

SEQ ID NO: 488346 - DNA, 15 bp, Homo sapiens
tgtaattccagcatt

SEQ ID NO: 488347 - DNA, 15 bp, Homo sapiens
gtaattccagcattt

SEQ ID NO: 488348 - DNA, 15 bp, Homo sapiens
taattccagcatttt

SEQ ID NO: 488349 - DNA, 15 bp, Homo sapiens
aattccagcattttg

SEQ ID NO: 488350 - DNA, 15 bp, Homo sapiens
attccagcattttgg

SEQ ID NO: 488351 - DNA, 15 bp, Homo sapiens
ttccagcattttggc

SEQ ID NO: 488352 - DNA, 15 bp, Homo sapiens
tccagcattttggca

SEQ ID NO: 488353 - DNA, 15 bp, Homo sapiens
ccagcattttggcag

SEQ ID NO: 488354 - DNA, 15 bp, Homo sapiens
cagcattttggcagg

SEQ ID NO: 488355 - DNA, 15 bp, Homo sapiens
agcattttggcaggc

SEQ ID NO: 488356 - DNA, 15 bp, Homo sapiens
gcattttggcaggct

SEQ ID NO: 488357 - DNA, 15 bp, Homo sapiens
cattttggcaggctg

SEQ ID NO: 488358 - DNA, 15 bp, Homo sapiens
attttggcaggctga

SEQ ID NO: 488359 - DNA, 15 bp, Homo sapiens
ttttggcaggctgag

SEQ ID NO: 488360 - DNA, 15 bp, Homo sapiens
tttggcaggctgagg

SEQ ID NO: 488361 - DNA, 15 bp, Homo sapiens
ttggcaggctgaggc

SEQ ID NO: 488362 - DNA, 15 bp, Homo sapiens
tggcaggctgaggca

SEQ ID NO: 488363 - DNA, 15 bp, Homo sapiens
caggctgaggcaggt

SEQ ID NO: 488364 - DNA, 15 bp, Homo sapiens
tgagaccagcctgat

SEQ ID NO: 488365 - DNA, 15 bp, Homo sapiens
gagaccagcctgatt

SEQ ID NO: 488366 - DNA, 15 bp, Homo sapiens
agaccagcctgatta

SEQ ID NO: 488367 - DNA, 15 bp, Homo sapiens
gaccagcctgattaa

SEQ ID NO: 488368 - DNA, 15 bp, Homo sapiens
accagcctgattaac

SEQ ID NO: 488369 - DNA, 15 bp, Homo sapiens
ccagcctgattaaca

SEQ ID NO: 488370 - DNA, 15 bp, Homo sapiens
cagcctgattaacat

SEQ ID NO: 488371 - DNA, 15 bp, Homo sapiens
agcctgattaacatg

SEQ ID NO: 488372 - DNA, 15 bp, Homo sapiens
gcctgattaacatgg

SEQ ID NO: 488373 - DNA, 15 bp, Homo sapiens
cctgattaacatggc

SEQ ID NO: 488374 - DNA, 15 bp, Homo sapiens
ctgattaacatggca

SEQ ID NO: 488375 - DNA, 15 bp, Homo sapiens
tgattaacatggcaa

SEQ ID NO: 488376 - DNA, 15 bp, Homo sapiens
gattaacatggcaaa

SEQ ID NO: 488377 - DNA, 15 bp, Homo sapiens
attaacatggcaaaa

SEQ ID NO: 488378 - DNA, 15 bp, Homo sapiens
ttaacatggcaaaac

SEQ ID NO: 488379 - DNA, 15 bp, Homo sapiens
taacatggcaaaacc

SEQ ID NO: 488380 - DNA, 15 bp, Homo sapiens
catggcaaaacccta

SEQ ID NO: 488381 - DNA, 15 bp, Homo sapiens
atggcaaaaccctat

SEQ ID NO: 488382 - DNA, 15 bp, Homo sapiens
tggcaaaaccctatc

SEQ ID NO: 488383 - DNA, 15 bp, Homo sapiens
ggcaaaaccctatct

SEQ ID NO: 488384 - DNA, 15 bp, Homo sapiens
gcaaaaccctatctc

SEQ ID NO: 488385 - DNA, 15 bp, Homo sapiens
caaaaccctatctct

SEQ ID NO: 488386 - DNA, 15 bp, Homo sapiens
aaaaccctatctcta

SEQ ID NO: 488387 - DNA, 15 bp, Homo sapiens
tctactaaaaatacc

SEQ ID NO: 488388 - DNA, 15 bp, Homo sapiens
ctactaaaaatacca

SEQ ID NO: 488389 - DNA, 15 bp, Homo sapiens
tactaaaaataccaa

SEQ ID NO: 488390 - DNA, 15 bp, Homo sapiens
actaaaaataccaaa

SEQ ID NO: 488391 - DNA, 15 bp, Homo sapiens
ctaaaaataccaaaa

SEQ ID NO: 488392 - DNA, 15 bp, Homo sapiens
taaaaataccaaaaa

SEQ ID NO: 488393 - DNA, 15 bp, Homo sapiens
aaaaataccaaaaaa

SEQ ID NO: 488394 - DNA, 15 bp, Homo sapiens
aaaataccaaaaaaa

SEQ ID NO: 488395 - DNA, 15 bp, Homo sapiens
aaataccaaaaaaat

SEQ ID NO: 488396 - DNA, 15 bp, Homo sapiens
aataccaaaaaaatt

SEQ ID NO: 488397 - DNA, 15 bp, Homo sapiens
ataccaaaaaaattt

SEQ ID NO: 488398 - DNA, 15 bp, Homo sapiens
taccaaaaaaatttt

SEQ ID NO: 488399 - DNA, 15 bp, Homo sapiens
accaaaaaaattttc

SEQ ID NO: 488400 - DNA, 15 bp, Homo sapiens
ccaaaaaaattttcc

SEQ ID NO: 488401 - DNA, 15 bp, Homo sapiens
caaaaaaattttcca

SEQ ID NO: 488402 - DNA, 15 bp, Homo sapiens
aaaaaaattttccag

SEQ ID NO: 488403 - DNA, 15 bp, Homo sapiens
aaaaaattttccagg

SEQ ID NO: 488404 - DNA, 15 bp, Homo sapiens
aaaaattttccaggt

SEQ ID NO: 488405 - DNA, 15 bp, Homo sapiens
aaaattttccaggta

SEQ ID NO: 488406 - DNA, 15 bp, Homo sapiens
aaattttccaggtat

SEQ ID NO: 488407 - DNA, 15 bp, Homo sapiens
aattttccaggtatg

SEQ ID NO: 488408 - DNA, 15 bp, Homo sapiens
attttccaggtatgg

SEQ ID NO: 488409 - DNA, 15 bp, Homo sapiens
ttttccaggtatggt

SEQ ID NO: 488410 - DNA, 15 bp, Homo sapiens
tttccaggtatggtg

SEQ ID NO: 488411 - DNA, 15 bp, Homo sapiens
ttccaggtatggtgg

SEQ ID NO: 488412 - DNA, 15 bp, Homo sapiens
tccaggtatggtggc

SEQ ID NO: 488413 - DNA, 15 bp, Homo sapiens
caggtatggtggcac

SEQ ID NO: 488414 - DNA, 15 bp, Homo sapiens
aggtatggtggcaca

SEQ ID NO: 488415 - DNA, 15 bp, Homo sapiens
ggtatggtggcacaa

SEQ ID NO: 488416 - DNA, 15 bp, Homo sapiens
gtatggtggcacaag

SEQ ID NO: 488417 - DNA, 15 bp, Homo sapiens
tatggtggcacaagc

SEQ ID NO: 488418 - DNA, 15 bp, Homo sapiens
atggtggcacaagcc

SEQ ID NO: 488419 - DNA, 15 bp, Homo sapiens
tggtggcacaagcct

SEQ ID NO: 488420 - DNA, 15 bp, Homo sapiens
ggtggcacaagcctg

SEQ ID NO: 488421 - DNA, 15 bp, Homo sapiens
gtggcacaagcctgt

SEQ ID NO: 488422 - DNA, 15 bp, Homo sapiens
tggcacaagcctgta

SEQ ID NO: 488423 - DNA, 15 bp, Homo sapiens
ggcacaagcctgtag

SEQ ID NO: 488424 - DNA, 15 bp, Homo sapiens
gcacaagcctgtagt

SEQ ID NO: 488425 - DNA, 15 bp, Homo sapiens
cacaagcctgtagtt

SEQ ID NO: 488426 - DNA, 15 bp, Homo sapiens
acaagcctgtagttg

SEQ ID NO: 488427 - DNA, 15 bp, Homo sapiens
caagcctgtagttgt

SEQ ID NO: 488428 - DNA, 15 bp, Homo sapiens
aagcctgtagttgta

SEQ ID NO: 488429 - DNA, 15 bp, Homo sapiens
agcctgtagttgtag

SEQ ID NO: 488430 - DNA, 15 bp, Homo sapiens
gcctgtagttgtagt

SEQ ID NO: 488431 - DNA, 15 bp, Homo sapiens
cctgtagttgtagtc

SEQ ID NO: 488432 - DNA, 15 bp, Homo sapiens
ctgtagttgtagtcc

SEQ ID NO: 488433 - DNA, 15 bp, Homo sapiens
tgtagttgtagtcct

SEQ ID NO: 488434 - DNA, 15 bp, Homo sapiens
gtagttgtagtccta

SEQ ID NO: 488435 - DNA, 15 bp, Homo sapiens
tagttgtagtcctac

SEQ ID NO: 488436 - DNA, 15 bp, Homo sapiens
agttgtagtcctacc

SEQ ID NO: 488437 - DNA, 15 bp, Homo sapiens
gttgtagtcctacct

SEQ ID NO: 488438 - DNA, 15 bp, Homo sapiens
ttgtagtcctaccta

SEQ ID NO: 488439 - DNA, 15 bp, Homo sapiens
tgtagtcctacctac

SEQ ID NO: 488440 - DNA, 15 bp, Homo sapiens
gtagtcctacctact

SEQ ID NO: 488441 - DNA, 15 bp, Homo sapiens
tagtcctacctactt

SEQ ID NO: 488442 - DNA, 15 bp, Homo sapiens
agtcctacctacttg

SEQ ID NO: 488443 - DNA, 15 bp, Homo sapiens
gtcctacctacttgg

SEQ ID NO: 488444 - DNA, 15 bp, Homo sapiens
tcctacctacttggg

SEQ ID NO: 488445 - DNA, 15 bp, Homo sapiens
cctacctacttggga

SEQ ID NO: 488446 - DNA, 15 bp, Homo sapiens
ctacctacttgggag

SEQ ID NO: 488447 - DNA, 15 bp, Homo sapiens
tacctacttgggagg

SEQ ID NO: 488448 - DNA, 15 bp, Homo sapiens
acctacttgggaggc

SEQ ID NO: 488449 - DNA, 15 bp, Homo sapiens
cctacttgggaggct

SEQ ID NO: 488450 - DNA, 15 bp, Homo sapiens
gggaggctgaggcat

SEQ ID NO: 488451 - DNA, 15 bp, Homo sapiens
ggaggctgaggcatg

SEQ ID NO: 488452 - DNA, 15 bp, Homo sapiens
gaggctgaggcatga

SEQ ID NO: 488453 - DNA, 15 bp, Homo sapiens
aggctgaggcatgag

SEQ ID NO: 488454 - DNA, 15 bp, Homo sapiens
ggctgaggcatgaga

SEQ ID NO: 488455 - DNA, 15 bp, Homo sapiens
gctgaggcatgagaa

SEQ ID NO: 488456 - DNA, 15 bp, Homo sapiens
ctgaggcatgagaat

SEQ ID NO: 488457 - DNA, 15 bp, Homo sapiens
tgaggcatgagaatc

SEQ ID NO: 488458 - DNA, 15 bp, Homo sapiens
gaggcatgagaatcg

SEQ ID NO: 488459 - DNA, 15 bp, Homo sapiens
aggcatgagaatcgc

SEQ ID NO: 488460 - DNA, 15 bp, Homo sapiens
ggcatgagaatcgct

SEQ ID NO: 488461 - DNA, 15 bp, Homo sapiens
gcatgagaatcgctt

SEQ ID NO: 488462 - DNA, 15 bp, Homo sapiens
catgagaatcgcttg

SEQ ID NO: 488463 - DNA, 15 bp, Homo sapiens
atgagaatcgcttga

SEQ ID NO: 488464 - DNA, 15 bp, Homo sapiens
tgagaatcgcttgaa

SEQ ID NO: 488465 - DNA, 15 bp, Homo sapiens
acctgggaggctgaa

SEQ ID NO: 488466 - DNA, 15 bp, Homo sapiens
cctgggaggctgaag

SEQ ID NO: 488467 - DNA, 15 bp, Homo sapiens
ctgggaggctgaagt

SEQ ID NO: 488468 - DNA, 15 bp, Homo sapiens
tgggaggctgaagtt

SEQ ID NO: 488469 - DNA, 15 bp, Homo sapiens
gctgaagttgcagtg

SEQ ID NO: 488470 - DNA, 15 bp, Homo sapiens
ctgaagttgcagtga

SEQ ID NO: 488471 - DNA, 15 bp, Homo sapiens
tgaagttgcagtgag

SEQ ID NO: 488472 - DNA, 15 bp, Homo sapiens
gaagttgcagtgagt

SEQ ID NO: 488473 - DNA, 15 bp, Homo sapiens
aagttgcagtgagtt

SEQ ID NO: 488474 - DNA, 15 bp, Homo sapiens
agttgcagtgagttg

SEQ ID NO: 488475 - DNA, 15 bp, Homo sapiens
gttgcagtgagttga

SEQ ID NO: 488476 - DNA, 15 bp, Homo sapiens
ttgcagtgagttgag

SEQ ID NO: 488477 - DNA, 15 bp, Homo sapiens
tgcagtgagttgaga

SEQ ID NO: 488478 - DNA, 15 bp, Homo sapiens
gcagtgagttgagat

SEQ ID NO: 488479 - DNA, 15 bp, Homo sapiens
cagtgagttgagatc

SEQ ID NO: 488480 - DNA, 15 bp, Homo sapiens
agtgagttgagatca

SEQ ID NO: 488481 - DNA, 15 bp, Homo sapiens
gtgagttgagatcat

SEQ ID NO: 488482 - DNA, 15 bp, Homo sapiens
tgagttgagatcatg

SEQ ID NO: 488483 - DNA, 15 bp, Homo sapiens
gagttgagatcatgc

SEQ ID NO: 488484 - DNA, 15 bp, Homo sapiens
agttgagatcatgcc

SEQ ID NO: 488485 - DNA, 15 bp, Homo sapiens
gttgagatcatgcca

SEQ ID NO: 488486 - DNA, 15 bp, Homo sapiens
ttgagatcatgccac

SEQ ID NO: 488487 - DNA, 15 bp, Homo sapiens
catgccactgcactt

SEQ ID NO: 488488 - DNA, 15 bp, Homo sapiens
atgccactgcacttc

SEQ ID NO: 488489 - DNA, 15 bp, Homo sapiens
tgccactgcacttca

SEQ ID NO: 488490 - DNA, 15 bp, Homo sapiens
actgcacttcagcct

SEQ ID NO: 488491 - DNA, 15 bp, Homo sapiens
ctgcacttcagcctg

SEQ ID NO: 488492 - DNA, 15 bp, Homo sapiens
tgcacttcagcctgg

SEQ ID NO: 488493 - DNA, 15 bp, Homo sapiens
gcacttcagcctggg

SEQ ID NO: 488494 - DNA, 15 bp, Homo sapiens
cacttcagcctgggc

SEQ ID NO: 488495 - DNA, 15 bp, Homo sapiens
acttcagcctgggca

SEQ ID NO: 488496 - DNA, 15 bp, Homo sapiens
cttcagcctgggcaa

SEQ ID NO: 488497 - DNA, 15 bp, Homo sapiens
ttcagcctgggcaac

SEQ ID NO: 488498 - DNA, 15 bp, Homo sapiens
cctgggcaacagaga

SEQ ID NO: 488499 - DNA, 15 bp, Homo sapiens
ctgggcaacagagac

SEQ ID NO: 488500 - DNA, 15 bp, Homo sapiens
tgggcaacagagact

SEQ ID NO: 488501 - DNA, 15 bp, Homo sapiens
gggcaacagagactc

SEQ ID NO: 488502 - DNA, 15 bp, Homo sapiens
ggcaacagagactct

SEQ ID NO: 488503 - DNA, 15 bp, Homo sapiens
gcaacagagactcta

SEQ ID NO: 488504 - DNA, 15 bp, Homo sapiens
caacagagactctat

SEQ ID NO: 488505 - DNA, 15 bp, Homo sapiens
aacagagactctatc

SEQ ID NO: 488506 - DNA, 15 bp, Homo sapiens
acagagactctatct

SEQ ID NO: 488507 - DNA, 15 bp, Homo sapiens
cagagactctatctc

SEQ ID NO: 488508 - DNA, 15 bp, Homo sapiens
agagactctatctca

SEQ ID NO: 488509 - DNA, 15 bp, Homo sapiens
gagactctatctcaa

SEQ ID NO: 488510 - DNA, 15 bp, Homo sapiens
actctatctcaaaac

SEQ ID NO: 488511 - DNA, 15 bp, Homo sapiens
ctctatctcaaaaca

SEQ ID NO: 488512 - DNA, 15 bp, Homo sapiens
tctatctcaaaacaa

SEQ ID NO: 488513 - DNA, 15 bp, Homo sapiens
ctatctcaaaacaac

SEQ ID NO: 488514 - DNA, 15 bp, Homo sapiens
tatctcaaaacaaca

SEQ ID NO: 488515 - DNA, 15 bp, Homo sapiens
atctcaaaacaacaa

SEQ ID NO: 488516 - DNA, 15 bp, Homo sapiens
caaaacaacaacaac

SEQ ID NO: 488517 - DNA, 15 bp, Homo sapiens
aaaacaacaacaaca

SEQ ID NO: 488518 - DNA, 15 bp, Homo sapiens
acaacaacaacaaaa

SEQ ID NO: 488519 - DNA, 15 bp, Homo sapiens
acaacaacaaaataa

SEQ ID NO: 488520 - DNA, 15 bp, Homo sapiens
caacaacaaaataaa

SEQ ID NO: 488521 - DNA, 15 bp, Homo sapiens
aacaacaaaataaat

SEQ ID NO: 488522 - DNA, 15 bp, Homo sapiens
acaacaaaataaatg

SEQ ID NO: 488523 - DNA, 15 bp, Homo sapiens
caacaaaataaatga

SEQ ID NO: 488524 - DNA, 15 bp, Homo sapiens
aacaaaataaatgaa

SEQ ID NO: 488525 - DNA, 15 bp, Homo sapiens
acaaaataaatgaat

SEQ ID NO: 488526 - DNA, 15 bp, Homo sapiens
caaaataaatgaata

SEQ ID NO: 488527 - DNA, 15 bp, Homo sapiens
aaaataaatgaataa

SEQ ID NO: 488528 - DNA, 15 bp, Homo sapiens
aaataaatgaataaa

SEQ ID NO: 488529 - DNA, 15 bp, Homo sapiens
aataaatgaataaat

SEQ ID NO: 488530 - DNA, 15 bp, Homo sapiens
atgaataaataaaac

SEQ ID NO: 488531 - DNA, 15 bp, Homo sapiens
tgaataaataaaaca

SEQ ID NO: 488532 - DNA, 15 bp, Homo sapiens
gaataaataaaacat

SEQ ID NO: 488533 - DNA, 15 bp, Homo sapiens
aataaataaaacata

SEQ ID NO: 488534 - DNA, 15 bp, Homo sapiens
ataaataaaacatat

SEQ ID NO: 488535 - DNA, 15 bp, Homo sapiens
taaataaaacatata

SEQ ID NO: 488536 - DNA, 15 bp, Homo sapiens
aaataaaacatatat

SEQ ID NO: 488537 - DNA, 15 bp, Homo sapiens
aataaaacatatatt

SEQ ID NO: 488538 - DNA, 15 bp, Homo sapiens
ataaaacatatattt

SEQ ID NO: 488539 - DNA, 15 bp, Homo sapiens
taaaacatatatttc

SEQ ID NO: 488540 - DNA, 15 bp, Homo sapiens
aaaacatatatttct

SEQ ID NO: 488541 - DNA, 15 bp, Homo sapiens
aaacatatatttctt

SEQ ID NO: 488542 - DNA, 15 bp, Homo sapiens
aacatatatttcttt

SEQ ID NO: 488543 - DNA, 15 bp, Homo sapiens
acatatatttctttg

SEQ ID NO: 488544 - DNA, 15 bp, Homo sapiens
catatatttctttgt

SEQ ID NO: 488545 - DNA, 15 bp, Homo sapiens
atatatttctttgtg

SEQ ID NO: 488546 - DNA, 15 bp, Homo sapiens
tatatttctttgtga

SEQ ID NO: 488547 - DNA, 15 bp, Homo sapiens
atatttctttgtgaa

SEQ ID NO: 488548 - DNA, 15 bp, Homo sapiens
tatttctttgtgaat

SEQ ID NO: 488549 - DNA, 15 bp, Homo sapiens
atttctttgtgaatt

SEQ ID NO: 488550 - DNA, 15 bp, Homo sapiens
tttctttgtgaattt

SEQ ID NO: 488551 - DNA, 15 bp, Homo sapiens
ttctttgtgaatttt

SEQ ID NO: 488552 - DNA, 15 bp, Homo sapiens
tctttgtgaattttc

SEQ ID NO: 488553 - DNA, 15 bp, Homo sapiens
ctttgtgaattttca

SEQ ID NO: 488554 - DNA, 15 bp, Homo sapiens
tttgtgaattttcag

SEQ ID NO: 488555 - DNA, 15 bp, Homo sapiens
ttgtgaattttcagg

SEQ ID NO: 488556 - DNA, 15 bp, Homo sapiens
tgtgaattttcagga

SEQ ID NO: 488557 - DNA, 15 bp, Homo sapiens
gtgaattttcaggaa

SEQ ID NO: 488558 - DNA, 15 bp, Homo sapiens
tgaattttcaggaat

SEQ ID NO: 488559 - DNA, 15 bp, Homo sapiens
gaattttcaggaata

SEQ ID NO: 488560 - DNA, 15 bp, Homo sapiens
aattttcaggaatat

SEQ ID NO: 488561 - DNA, 15 bp, Homo sapiens
attttcaggaatatt

SEQ ID NO: 488562 - DNA, 15 bp, Homo sapiens
ttttcaggaatattt

SEQ ID NO: 488563 - DNA, 15 bp, Homo sapiens
tttcaggaatatttg

SEQ ID NO: 488564 - DNA, 15 bp, Homo sapiens
ttcaggaatatttgc

SEQ ID NO: 488565 - DNA, 15 bp, Homo sapiens
tcaggaatatttgcc

SEQ ID NO: 488566 - DNA, 15 bp, Homo sapiens
caggaatatttgcct

SEQ ID NO: 488567 - DNA, 15 bp, Homo sapiens
aggaatatttgcctg

SEQ ID NO: 488568 - DNA, 15 bp, Homo sapiens
ggaatatttgcctga

SEQ ID NO: 488569 - DNA, 15 bp, Homo sapiens
gaatatttgcctgaa

SEQ ID NO: 488570 - DNA, 15 bp, Homo sapiens
aatatttgcctgaag

SEQ ID NO: 488571 - DNA, 15 bp, Homo sapiens
atatttgcctgaaga

SEQ ID NO: 488572 - DNA, 15 bp, Homo sapiens
tatttgcctgaagat

SEQ ID NO: 488573 - DNA, 15 bp, Homo sapiens
atttgcctgaagatt

SEQ ID NO: 488574 - DNA, 15 bp, Homo sapiens
tttgcctgaagatta

SEQ ID NO: 488575 - DNA, 15 bp, Homo sapiens
ttgcctgaagattat

SEQ ID NO: 488576 - DNA, 15 bp, Homo sapiens
tgcctgaagattata

SEQ ID NO: 488577 - DNA, 15 bp, Homo sapiens
gcctgaagattatat

SEQ ID NO: 488578 - DNA, 15 bp, Homo sapiens
cctgaagattatatt

SEQ ID NO: 488579 - DNA, 15 bp, Homo sapiens
ctgaagattatatta

SEQ ID NO: 488580 - DNA, 15 bp, Homo sapiens
tgaagattatattat

SEQ ID NO: 488581 - DNA, 15 bp, Homo sapiens
gaagattatattatg

SEQ ID NO: 488582 - DNA, 15 bp, Homo sapiens
aagattatattatgg

SEQ ID NO: 488583 - DNA, 15 bp, Homo sapiens
agattatattatggt

SEQ ID NO: 488584 - DNA, 15 bp, Homo sapiens
gattatattatggtt

SEQ ID NO: 488585 - DNA, 15 bp, Homo sapiens
attatattatggttt

SEQ ID NO: 488586 - DNA, 15 bp, Homo sapiens
ttatattatggtttc

SEQ ID NO: 488587 - DNA, 15 bp, Homo sapiens
tatattatggtttcc

SEQ ID NO: 488588 - DNA, 15 bp, Homo sapiens
atattatggtttcca

SEQ ID NO: 488589 - DNA, 15 bp, Homo sapiens
tattatggtttccac

SEQ ID NO: 488590 - DNA, 15 bp, Homo sapiens
attatggtttccacc

SEQ ID NO: 488591 - DNA, 15 bp, Homo sapiens
ttatggtttccacca

SEQ ID NO: 488592 - DNA, 15 bp, Homo sapiens
tatggtttccaccag

SEQ ID NO: 488593 - DNA, 15 bp, Homo sapiens
atggtttccaccagc

SEQ ID NO: 488594 - DNA, 15 bp, Homo sapiens
tggtttccaccagca

SEQ ID NO: 488595 - DNA, 15 bp, Homo sapiens
ggtttccaccagcac

SEQ ID NO: 488596 - DNA, 15 bp, Homo sapiens
gtttccaccagcaca

SEQ ID NO: 488597 - DNA, 15 bp, Homo sapiens
tttccaccagcacat

SEQ ID NO: 488598 - DNA, 15 bp, Homo sapiens
ttccaccagcacatg

SEQ ID NO: 488599 - DNA, 15 bp, Homo sapiens
tccaccagcacatga

SEQ ID NO: 488600 - DNA, 15 bp, Homo sapiens
ccaccagcacatgaa

SEQ ID NO: 488601 - DNA, 15 bp, Homo sapiens
caccagcacatgaat

SEQ ID NO: 488602 - DNA, 15 bp, Homo sapiens
accagcacatgaata

SEQ ID NO: 488603 - DNA, 15 bp, Homo sapiens
ccagcacatgaatat

SEQ ID NO: 488604 - DNA, 15 bp, Homo sapiens
cagcacatgaatata

SEQ ID NO: 488605 - DNA, 15 bp, Homo sapiens
agcacatgaatatat

SEQ ID NO: 488606 - DNA, 15 bp, Homo sapiens
gcacatgaatatatc

SEQ ID NO: 488607 - DNA, 15 bp, Homo sapiens
cacatgaatatatct

SEQ ID NO: 488608 - DNA, 15 bp, Homo sapiens
acatgaatatatcta

SEQ ID NO: 488609 - DNA, 15 bp, Homo sapiens
catgaatatatctat

SEQ ID NO: 488610 - DNA, 15 bp, Homo sapiens
atgaatatatctatt

SEQ ID NO: 488611 - DNA, 15 bp, Homo sapiens
tgaatatatctattt

SEQ ID NO: 488612 - DNA, 15 bp, Homo sapiens
gaatatatctatttg

SEQ ID NO: 488613 - DNA, 15 bp, Homo sapiens
aatatatctatttgt

SEQ ID NO: 488614 - DNA, 15 bp, Homo sapiens
atatatctatttgtg

SEQ ID NO: 488615 - DNA, 15 bp, Homo sapiens
tatatctatttgtgt

SEQ ID NO: 488616 - DNA, 15 bp, Homo sapiens
atatctatttgtgtt

SEQ ID NO: 488617 - DNA, 15 bp, Homo sapiens
tatctatttgtgttt

SEQ ID NO: 488618 - DNA, 15 bp, Homo sapiens
atctatttgtgtttt

SEQ ID NO: 488619 - DNA, 15 bp, Homo sapiens
tctatttgtgttttg

SEQ ID NO: 488620 - DNA, 15 bp, Homo sapiens
ctatttgtgttttgc

SEQ ID NO: 488621 - DNA, 15 bp, Homo sapiens
tatttgtgttttgcc

SEQ ID NO: 488622 - DNA, 15 bp, Homo sapiens
atttgtgttttgcca

SEQ ID NO: 488623 - DNA, 15 bp, Homo sapiens
tttgtgttttgccag

SEQ ID NO: 488624 - DNA, 15 bp, Homo sapiens
ttgtgttttgccagt

SEQ ID NO: 488625 - DNA, 15 bp, Homo sapiens
tgtgttttgccagtg

SEQ ID NO: 488626 - DNA, 15 bp, Homo sapiens
gtgttttgccagtgt

SEQ ID NO: 488627 - DNA, 15 bp, Homo sapiens
tgttttgccagtgtt

SEQ ID NO: 488628 - DNA, 15 bp, Homo sapiens
gttttgccagtgttt

SEQ ID NO: 488629 - DNA, 15 bp, Homo sapiens
ttttgccagtgtttc

SEQ ID NO: 488630 - DNA, 15 bp, Homo sapiens
tttgccagtgtttcc

SEQ ID NO: 488631 - DNA, 15 bp, Homo sapiens
ttgccagtgtttccc

SEQ ID NO: 488632 - DNA, 15 bp, Homo sapiens
tgccagtgtttccca

SEQ ID NO: 488633 - DNA, 15 bp, Homo sapiens
gccagtgtttcccag

SEQ ID NO: 488634 - DNA, 15 bp, Homo sapiens
ccagtgtttcccagg

SEQ ID NO: 488635 - DNA, 15 bp, Homo sapiens
cagtgtttcccaggt

SEQ ID NO: 488636 - DNA, 15 bp, Homo sapiens
agtgtttcccaggtt

SEQ ID NO: 488637 - DNA, 15 bp, Homo sapiens
gtgtttcccaggttt

SEQ ID NO: 488638 - DNA, 15 bp, Homo sapiens
tgtttcccaggtttt

SEQ ID NO: 488639 - DNA, 15 bp, Homo sapiens
gtttcccaggttttc

SEQ ID NO: 488640 - DNA, 15 bp, Homo sapiens
tttcccaggttttca

SEQ ID NO: 488641 - DNA, 15 bp, Homo sapiens
ttcccaggttttcat

SEQ ID NO: 488642 - DNA, 15 bp, Homo sapiens
tcccaggttttcatt

SEQ ID NO: 488643 - DNA, 15 bp, Homo sapiens
cccaggttttcattt

SEQ ID NO: 488644 - DNA, 15 bp, Homo sapiens
ccaggttttcatttg

SEQ ID NO: 488645 - DNA, 15 bp, Homo sapiens
caggttttcatttgt

SEQ ID NO: 488646 - DNA, 15 bp, Homo sapiens
ggttttcatttgtag

SEQ ID NO: 488647 - DNA, 15 bp, Homo sapiens
gttttcatttgtaga

SEQ ID NO: 488648 - DNA, 15 bp, Homo sapiens
ttttcatttgtagat

SEQ ID NO: 488649 - DNA, 15 bp, Homo sapiens
tttcatttgtagatc

SEQ ID NO: 488650 - DNA, 15 bp, Homo sapiens
ttcatttgtagatct

SEQ ID NO: 488651 - DNA, 15 bp, Homo sapiens
tcatttgtagatcta

SEQ ID NO: 488652 - DNA, 15 bp, Homo sapiens
catttgtagatctac

SEQ ID NO: 488653 - DNA, 15 bp, Homo sapiens
atttgtagatctact

SEQ ID NO: 488654 - DNA, 15 bp, Homo sapiens
tttgtagatctacta

SEQ ID NO: 488655 - DNA, 15 bp, Homo sapiens
ttgtagatctactat

SEQ ID NO: 488656 - DNA, 15 bp, Homo sapiens
tgtagatctactata

SEQ ID NO: 488657 - DNA, 15 bp, Homo sapiens
gtagatctactataa

SEQ ID NO: 488658 - DNA, 15 bp, Homo sapiens
tagatctactataat

SEQ ID NO: 488659 - DNA, 15 bp, Homo sapiens
agatctactataatg

SEQ ID NO: 488660 - DNA, 15 bp, Homo sapiens
gatctactataatgc

SEQ ID NO: 488661 - DNA, 15 bp, Homo sapiens
atctactataatgct

SEQ ID NO: 488662 - DNA, 15 bp, Homo sapiens
tctactataatgctt

SEQ ID NO: 488663 - DNA, 15 bp, Homo sapiens
ctactataatgcttc

SEQ ID NO: 488664 - DNA, 15 bp, Homo sapiens
tactataatgcttct

SEQ ID NO: 488665 - DNA, 15 bp, Homo sapiens
actataatgcttctc

SEQ ID NO: 488666 - DNA, 15 bp, Homo sapiens
ctataatgcttctca

SEQ ID NO: 488667 - DNA, 15 bp, Homo sapiens
tataatgcttctcaa

SEQ ID NO: 488668 - DNA, 15 bp, Homo sapiens
ataatgcttctcaaa

SEQ ID NO: 488669 - DNA, 15 bp, Homo sapiens
taatgcttctcaaag

SEQ ID NO: 488670 - DNA, 15 bp, Homo sapiens
aatgcttctcaaagt

SEQ ID NO: 488671 - DNA, 15 bp, Homo sapiens
atgcttctcaaagtt

SEQ ID NO: 488672 - DNA, 15 bp, Homo sapiens
tgcttctcaaagttt

SEQ ID NO: 488673 - DNA, 15 bp, Homo sapiens
gcttctcaaagtttg

SEQ ID NO: 488674 - DNA, 15 bp, Homo sapiens
cttctcaaagtttgc

SEQ ID NO: 488675 - DNA, 15 bp, Homo sapiens
ttctcaaagtttgca

SEQ ID NO: 488676 - DNA, 15 bp, Homo sapiens
tctcaaagtttgcag

SEQ ID NO: 488677 - DNA, 15 bp, Homo sapiens
ctcaaagtttgcaga

SEQ ID NO: 488678 - DNA, 15 bp, Homo sapiens
tcaaagtttgcagaa

SEQ ID NO: 488679 - DNA, 15 bp, Homo sapiens
caaagtttgcagaat

SEQ ID NO: 488680 - DNA, 15 bp, Homo sapiens
aaagtttgcagaatc

SEQ ID NO: 488681 - DNA, 15 bp, Homo sapiens
aagtttgcagaatca

SEQ ID NO: 488682 - DNA, 15 bp, Homo sapiens
agtttgcagaatcac

SEQ ID NO: 488683 - DNA, 15 bp, Homo sapiens
gtttgcagaatcaca

SEQ ID NO: 488684 - DNA, 15 bp, Homo sapiens
tttgcagaatcacat

SEQ ID NO: 488685 - DNA, 15 bp, Homo sapiens
ttgcagaatcacatt

SEQ ID NO: 488686 - DNA, 15 bp, Homo sapiens
tgcagaatcacattt

SEQ ID NO: 488687 - DNA, 15 bp, Homo sapiens
gcagaatcacattta

SEQ ID NO: 488688 - DNA, 15 bp, Homo sapiens
cagaatcacatttac

SEQ ID NO: 488689 - DNA, 15 bp, Homo sapiens
agaatcacatttaca

SEQ ID NO: 488690 - DNA, 15 bp, Homo sapiens
gaatcacatttacac

SEQ ID NO: 488691 - DNA, 15 bp, Homo sapiens
aatcacatttacact

SEQ ID NO: 488692 - DNA, 15 bp, Homo sapiens
atcacatttacacta

SEQ ID NO: 488693 - DNA, 15 bp, Homo sapiens
tcacatttacactac

SEQ ID NO: 488694 - DNA, 15 bp, Homo sapiens
cacatttacactaca

SEQ ID NO: 488695 - DNA, 15 bp, Homo sapiens
acatttacactacat

SEQ ID NO: 488696 - DNA, 15 bp, Homo sapiens
catttacactacatc

SEQ ID NO: 488697 - DNA, 15 bp, Homo sapiens
atttacactacatca

SEQ ID NO: 488698 - DNA, 15 bp, Homo sapiens
tttacactacatcag

SEQ ID NO: 488699 - DNA, 15 bp, Homo sapiens
ttacactacatcagt

SEQ ID NO: 488700 - DNA, 15 bp, Homo sapiens
tacactacatcagtc

SEQ ID NO: 488701 - DNA, 15 bp, Homo sapiens
acactacatcagtct

SEQ ID NO: 488702 - DNA, 15 bp, Homo sapiens
cactacatcagtctc

SEQ ID NO: 488703 - DNA, 15 bp, Homo sapiens
actacatcagtctcc

SEQ ID NO: 488704 - DNA, 15 bp, Homo sapiens
ctacatcagtctcca

SEQ ID NO: 488705 - DNA, 15 bp, Homo sapiens
tacatcagtctccac

SEQ ID NO: 488706 - DNA, 15 bp, Homo sapiens
acatcagtctccaca

SEQ ID NO: 488707 - DNA, 15 bp, Homo sapiens
catcagtctccacac

SEQ ID NO: 488708 - DNA, 15 bp, Homo sapiens
atcagtctccacacc

SEQ ID NO: 488709 - DNA, 15 bp, Homo sapiens
tcagtctccacaccc

SEQ ID NO: 488710 - DNA, 15 bp, Homo sapiens
cagtctccacaccca

SEQ ID NO: 488711 - DNA, 15 bp, Homo sapiens
agtctccacacccac

SEQ ID NO: 488712 - DNA, 15 bp, Homo sapiens
gtctccacacccacc

SEQ ID NO: 488713 - DNA, 15 bp, Homo sapiens
tctccacacccacct

SEQ ID NO: 488714 - DNA, 15 bp, Homo sapiens
ctccacacccacctc

SEQ ID NO: 488715 - DNA, 15 bp, Homo sapiens
tccacacccacctcc

SEQ ID NO: 488716 - DNA, 15 bp, Homo sapiens
tttttccaagttcca

SEQ ID NO: 488717 - DNA, 15 bp, Homo sapiens
ttttccaagttccat

SEQ ID NO: 488718 - DNA, 15 bp, Homo sapiens
tttccaagttccatt

SEQ ID NO: 488719 - DNA, 15 bp, Homo sapiens
ttccaagttccattt

SEQ ID NO: 488720 - DNA, 15 bp, Homo sapiens
tccaagttccatttc

SEQ ID NO: 488721 - DNA, 15 bp, Homo sapiens
ccaagttccatttcc

SEQ ID NO: 488722 - DNA, 15 bp, Homo sapiens
caagttccatttcct

SEQ ID NO: 488723 - DNA, 15 bp, Homo sapiens
aagttccatttccta

SEQ ID NO: 488724 - DNA, 15 bp, Homo sapiens
agttccatttcctaa

SEQ ID NO: 488725 - DNA, 15 bp, Homo sapiens
gttccatttcctaaa

SEQ ID NO: 488726 - DNA, 15 bp, Homo sapiens
ttccatttcctaaag

SEQ ID NO: 488727 - DNA, 15 bp, Homo sapiens
tccatttcctaaaga

SEQ ID NO: 488728 - DNA, 15 bp, Homo sapiens
ccatttcctaaagaa

SEQ ID NO: 488729 - DNA, 15 bp, Homo sapiens
catttcctaaagaat

SEQ ID NO: 488730 - DNA, 15 bp, Homo sapiens
atttcctaaagaatt

SEQ ID NO: 488731 - DNA, 15 bp, Homo sapiens
tttcctaaagaattt

SEQ ID NO: 488732 - DNA, 15 bp, Homo sapiens
ttcctaaagaattta

SEQ ID NO: 488733 - DNA, 15 bp, Homo sapiens
tcctaaagaatttac

SEQ ID NO: 488734 - DNA, 15 bp, Homo sapiens
cctaaagaatttact

SEQ ID NO: 488735 - DNA, 15 bp, Homo sapiens
ctaaagaatttactc

SEQ ID NO: 488736 - DNA, 15 bp, Homo sapiens
taaagaatttactct

SEQ ID NO: 488737 - DNA, 15 bp, Homo sapiens
aaagaatttactctt

SEQ ID NO: 488738 - DNA, 15 bp, Homo sapiens
aagaatttactctta

SEQ ID NO: 488739 - DNA, 15 bp, Homo sapiens
agaatttactcttaa

SEQ ID NO: 488740 - DNA, 15 bp, Homo sapiens
gaatttactcttaaa

SEQ ID NO: 488741 - DNA, 15 bp, Homo sapiens
aatttactcttaaat

SEQ ID NO: 488742 - DNA, 15 bp, Homo sapiens
atttactcttaaatt

SEQ ID NO: 488743 - DNA, 15 bp, Homo sapiens
tttactcttaaattt

SEQ ID NO: 488744 - DNA, 15 bp, Homo sapiens
ttactcttaaatttt

SEQ ID NO: 488745 - DNA, 15 bp, Homo sapiens
tactcttaaattttt

SEQ ID NO: 488746 - DNA, 15 bp, Homo sapiens
actcttaaatttttc

SEQ ID NO: 488747 - DNA, 15 bp, Homo sapiens
ctcttaaatttttct

SEQ ID NO: 488748 - DNA, 15 bp, Homo sapiens
tcttaaatttttctc

SEQ ID NO: 488749 - DNA, 15 bp, Homo sapiens
cttaaatttttctca

SEQ ID NO: 488750 - DNA, 15 bp, Homo sapiens
ttaaatttttctcaa

SEQ ID NO: 488751 - DNA, 15 bp, Homo sapiens
taaatttttctcaaa

SEQ ID NO: 488752 - DNA, 15 bp, Homo sapiens
aaatttttctcaaag

SEQ ID NO: 488753 - DNA, 15 bp, Homo sapiens
aatttttctcaaagt

SEQ ID NO: 488754 - DNA, 15 bp, Homo sapiens
atttttctcaaagta

SEQ ID NO: 488755 - DNA, 15 bp, Homo sapiens
tttttctcaaagtat

SEQ ID NO: 488756 - DNA, 15 bp, Homo sapiens
ttttctcaaagtata

SEQ ID NO: 488757 - DNA, 15 bp, Homo sapiens
tttctcaaagtatac

SEQ ID NO: 488758 - DNA, 15 bp, Homo sapiens
ttctcaaagtatact

SEQ ID NO: 488759 - DNA, 15 bp, Homo sapiens
tctcaaagtatactc

SEQ ID NO: 488760 - DNA, 15 bp, Homo sapiens
ctcaaagtatactct

SEQ ID NO: 488761 - DNA, 15 bp, Homo sapiens
tcaaagtatactctg

SEQ ID NO: 488762 - DNA, 15 bp, Homo sapiens
caaagtatactctga

SEQ ID NO: 488763 - DNA, 15 bp, Homo sapiens
aaagtatactctgac

SEQ ID NO: 488764 - DNA, 15 bp, Homo sapiens
aagtatactctgaca

SEQ ID NO: 488765 - DNA, 15 bp, Homo sapiens
agtatactctgacat

SEQ ID NO: 488766 - DNA, 15 bp, Homo sapiens
gtatactctgacatc

SEQ ID NO: 488767 - DNA, 15 bp, Homo sapiens
tatactctgacatcc

SEQ ID NO: 488768 - DNA, 15 bp, Homo sapiens
atactctgacatcca

SEQ ID NO: 488769 - DNA, 15 bp, Homo sapiens
tactctgacatccag

SEQ ID NO: 488770 - DNA, 15 bp, Homo sapiens
actctgacatccaga

SEQ ID NO: 488771 - DNA, 15 bp, Homo sapiens
ctctgacatccagat

SEQ ID NO: 488772 - DNA, 15 bp, Homo sapiens
tctgacatccagatt

SEQ ID NO: 488773 - DNA, 15 bp, Homo sapiens
ctgacatccagattt

SEQ ID NO: 488774 - DNA, 15 bp, Homo sapiens
tgacatccagatttt

SEQ ID NO: 488775 - DNA, 15 bp, Homo sapiens
gacatccagatttta

SEQ ID NO: 488776 - DNA, 15 bp, Homo sapiens
acatccagattttac

SEQ ID NO: 488777 - DNA, 15 bp, Homo sapiens
catccagattttaca

SEQ ID NO: 488778 - DNA, 15 bp, Homo sapiens
atccagattttacaa

SEQ ID NO: 488779 - DNA, 15 bp, Homo sapiens
tccagattttacaaa

SEQ ID NO: 488780 - DNA, 15 bp, Homo sapiens
ccagattttacaaaa

SEQ ID NO: 488781 - DNA, 15 bp, Homo sapiens
cagattttacaaaag

SEQ ID NO: 488782 - DNA, 15 bp, Homo sapiens
agattttacaaaagc

SEQ ID NO: 488783 - DNA, 15 bp, Homo sapiens
gattttacaaaagct

SEQ ID NO: 488784 - DNA, 15 bp, Homo sapiens
attttacaaaagctg

SEQ ID NO: 488785 - DNA, 15 bp, Homo sapiens
ttttacaaaagctgg

SEQ ID NO: 488786 - DNA, 15 bp, Homo sapiens
tttacaaaagctgga

SEQ ID NO: 488787 - DNA, 15 bp, Homo sapiens
ttacaaaagctggac

SEQ ID NO: 488788 - DNA, 15 bp, Homo sapiens
tacaaaagctggacc

SEQ ID NO: 488789 - DNA, 15 bp, Homo sapiens
acaaaagctggaccc

SEQ ID NO: 488790 - DNA, 15 bp, Homo sapiens
caaaagctggaccca

SEQ ID NO: 488791 - DNA, 15 bp, Homo sapiens
aaaagctggacccat

SEQ ID NO: 488792 - DNA, 15 bp, Homo sapiens
aaagctggacccatg

SEQ ID NO: 488793 - DNA, 15 bp, Homo sapiens
aagctggacccatgt

SEQ ID NO: 488794 - DNA, 15 bp, Homo sapiens
agctggacccatgtc

SEQ ID NO: 488795 - DNA, 15 bp, Homo sapiens
gctggacccatgtca

SEQ ID NO: 488796 - DNA, 15 bp, Homo sapiens
ctggacccatgtcat

SEQ ID NO: 488797 - DNA, 15 bp, Homo sapiens
tggacccatgtcatt

SEQ ID NO: 488798 - DNA, 15 bp, Homo sapiens
ggacccatgtcattt

SEQ ID NO: 488799 - DNA, 15 bp, Homo sapiens
gacccatgtcatttt

SEQ ID NO: 488800 - DNA, 15 bp, Homo sapiens
acccatgtcatttta

SEQ ID NO: 488801 - DNA, 15 bp, Homo sapiens
cccatgtcattttaa

SEQ ID NO: 488802 - DNA, 15 bp, Homo sapiens
ccatgtcattttaaa

SEQ ID NO: 488803 - DNA, 15 bp, Homo sapiens
catgtcattttaaaa

SEQ ID NO: 488804 - DNA, 15 bp, Homo sapiens
atgtcattttaaaac

SEQ ID NO: 488805 - DNA, 15 bp, Homo sapiens
tgtcattttaaaaca

SEQ ID NO: 488806 - DNA, 15 bp, Homo sapiens
gtcattttaaaacag

SEQ ID NO: 488807 - DNA, 15 bp, Homo sapiens
tcattttaaaacaga

SEQ ID NO: 488808 - DNA, 15 bp, Homo sapiens
cattttaaaacagaa

SEQ ID NO: 488809 - DNA, 15 bp, Homo sapiens
attttaaaacagaac

SEQ ID NO: 488810 - DNA, 15 bp, Homo sapiens
ttttaaaacagaaca

SEQ ID NO: 488811 - DNA, 15 bp, Homo sapiens
tttaaaacagaacat

SEQ ID NO: 488812 - DNA, 15 bp, Homo sapiens
ttaaaacagaacatt

SEQ ID NO: 488813 - DNA, 15 bp, Homo sapiens
taaaacagaacatta

SEQ ID NO: 488814 - DNA, 15 bp, Homo sapiens
aaaacagaacattat

SEQ ID NO: 488815 - DNA, 15 bp, Homo sapiens
aaacagaacattatt

SEQ ID NO: 488816 - DNA, 15 bp, Homo sapiens
aacagaacattatta

SEQ ID NO: 488817 - DNA, 15 bp, Homo sapiens
acagaacattattaa

SEQ ID NO: 488818 - DNA, 15 bp, Homo sapiens
cagaacattattaaa

SEQ ID NO: 488819 - DNA, 15 bp, Homo sapiens
agaacattattaaaa

SEQ ID NO: 488820 - DNA, 15 bp, Homo sapiens
gaacattattaaaaa

SEQ ID NO: 488821 - DNA, 15 bp, Homo sapiens
aacattattaaaaat

SEQ ID NO: 488822 - DNA, 15 bp, Homo sapiens
acattattaaaaata

SEQ ID NO: 488823 - DNA, 15 bp, Homo sapiens
cattattaaaaataa

SEQ ID NO: 488824 - DNA, 15 bp, Homo sapiens
attattaaaaataaa

SEQ ID NO: 488825 - DNA, 15 bp, Homo sapiens
ttattaaaaataaat

SEQ ID NO: 488826 - DNA, 15 bp, Homo sapiens
tattaaaaataaata

SEQ ID NO: 488827 - DNA, 15 bp, Homo sapiens
ttaaaaataaataat

SEQ ID NO: 488828 - DNA, 15 bp, Homo sapiens
taaaaataaataatc

SEQ ID NO: 488829 - DNA, 15 bp, Homo sapiens
aaaaataaataatca

SEQ ID NO: 488830 - DNA, 15 bp, Homo sapiens
aaaataaataatcat

SEQ ID NO: 488831 - DNA, 15 bp, Homo sapiens
aaataaataatcata

SEQ ID NO: 488832 - DNA, 15 bp, Homo sapiens
aataaataatcataa

SEQ ID NO: 488833 - DNA, 15 bp, Homo sapiens
taaataatcataatt

SEQ ID NO: 488834 - DNA, 15 bp, Homo sapiens
aaataatcataattt

SEQ ID NO: 488835 - DNA, 15 bp, Homo sapiens
aataatcataattta

SEQ ID NO: 488836 - DNA, 15 bp, Homo sapiens
ataatcataatttag

SEQ ID NO: 488837 - DNA, 15 bp, Homo sapiens
taatcataatttaga

SEQ ID NO: 488838 - DNA, 15 bp, Homo sapiens
aatcataatttagag

SEQ ID NO: 488839 - DNA, 15 bp, Homo sapiens
atcataatttagagc

SEQ ID NO: 488840 - DNA, 15 bp, Homo sapiens
tcataatttagagca

SEQ ID NO: 488841 - DNA, 15 bp, Homo sapiens
cataatttagagcaa

SEQ ID NO: 488842 - DNA, 15 bp, Homo sapiens
ataatttagagcaaa

SEQ ID NO: 488843 - DNA, 15 bp, Homo sapiens
taatttagagcaaaa

SEQ ID NO: 488844 - DNA, 15 bp, Homo sapiens
aatttagagcaaaaa

SEQ ID NO: 488845 - DNA, 15 bp, Homo sapiens
atttagagcaaaaat

SEQ ID NO: 488846 - DNA, 15 bp, Homo sapiens
tttagagcaaaaatg

SEQ ID NO: 488847 - DNA, 15 bp, Homo sapiens
ttagagcaaaaatga

SEQ ID NO: 488848 - DNA, 15 bp, Homo sapiens
tagagcaaaaatgaa

SEQ ID NO: 488849 - DNA, 15 bp, Homo sapiens
agagcaaaaatgaat

SEQ ID NO: 488850 - DNA, 15 bp, Homo sapiens
gagcaaaaatgaatt

SEQ ID NO: 488851 - DNA, 15 bp, Homo sapiens
agcaaaaatgaattg

SEQ ID NO: 488852 - DNA, 15 bp, Homo sapiens
gcaaaaatgaattgt

SEQ ID NO: 488853 - DNA, 15 bp, Homo sapiens
caaaaatgaattgta

SEQ ID NO: 488854 - DNA, 15 bp, Homo sapiens
aaaaatgaattgtaa

SEQ ID NO: 488855 - DNA, 15 bp, Homo sapiens
aaaatgaattgtaac

SEQ ID NO: 488856 - DNA, 15 bp, Homo sapiens
aaatgaattgtaaca

SEQ ID NO: 488857 - DNA, 15 bp, Homo sapiens
aatgaattgtaacag

SEQ ID NO: 488858 - DNA, 15 bp, Homo sapiens
atgaattgtaacagg

SEQ ID NO: 488859 - DNA, 15 bp, Homo sapiens
tgaattgtaacaggt

SEQ ID NO: 488860 - DNA, 15 bp, Homo sapiens
gaattgtaacaggta

SEQ ID NO: 488861 - DNA, 15 bp, Homo sapiens
aattgtaacaggtaa

SEQ ID NO: 488862 - DNA, 15 bp, Homo sapiens
attgtaacaggtaaa

SEQ ID NO: 488863 - DNA, 15 bp, Homo sapiens
ttgtaacaggtaaat

SEQ ID NO: 488864 - DNA, 15 bp, Homo sapiens
tgtaacaggtaaatg

SEQ ID NO: 488865 - DNA, 15 bp, Homo sapiens
gtaacaggtaaatgt

SEQ ID NO: 488866 - DNA, 15 bp, Homo sapiens
taacaggtaaatgta

SEQ ID NO: 488867 - DNA, 15 bp, Homo sapiens
aacaggtaaatgtat

SEQ ID NO: 488868 - DNA, 15 bp, Homo sapiens
acaggtaaatgtatg

SEQ ID NO: 488869 - DNA, 15 bp, Homo sapiens
caggtaaatgtatgt

SEQ ID NO: 488870 - DNA, 15 bp, Homo sapiens
aggtaaatgtatgta

SEQ ID NO: 488871 - DNA, 15 bp, Homo sapiens
ggtaaatgtatgtat

SEQ ID NO: 488872 - DNA, 15 bp, Homo sapiens
gtaaatgtatgtatc

SEQ ID NO: 488873 - DNA, 15 bp, Homo sapiens
taaatgtatgtatct

SEQ ID NO: 488874 - DNA, 15 bp, Homo sapiens
aaatgtatgtatctc

SEQ ID NO: 488875 - DNA, 15 bp, Homo sapiens
aatgtatgtatctct

SEQ ID NO: 488876 - DNA, 15 bp, Homo sapiens
atgtatgtatctctt

SEQ ID NO: 488877 - DNA, 15 bp, Homo sapiens
tgtatgtatctcttt

SEQ ID NO: 488878 - DNA, 15 bp, Homo sapiens
gtatgtatctctttt

SEQ ID NO: 488879 - DNA, 15 bp, Homo sapiens
tatgtatctcttttt

SEQ ID NO: 488880 - DNA, 15 bp, Homo sapiens
atgtatctcttttta

SEQ ID NO: 488881 - DNA, 15 bp, Homo sapiens
gtatctctttttatg

SEQ ID NO: 488882 - DNA, 15 bp, Homo sapiens
tatctctttttatgg

SEQ ID NO: 488883 - DNA, 15 bp, Homo sapiens
atctctttttatggc

SEQ ID NO: 488884 - DNA, 15 bp, Homo sapiens
tctctttttatggcc

SEQ ID NO: 488885 - DNA, 15 bp, Homo sapiens
ctctttttatggcct

SEQ ID NO: 488886 - DNA, 15 bp, Homo sapiens
tctttttatggcctc

SEQ ID NO: 488887 - DNA, 15 bp, Homo sapiens
ctttttatggcctca

SEQ ID NO: 488888 - DNA, 15 bp, Homo sapiens
tttttatggcctcac

SEQ ID NO: 488889 - DNA, 15 bp, Homo sapiens
ttttatggcctcact

SEQ ID NO: 488890 - DNA, 15 bp, Homo sapiens
tttatggcctcactt

SEQ ID NO: 488891 - DNA, 15 bp, Homo sapiens
ttatggcctcacttt

SEQ ID NO: 488892 - DNA, 15 bp, Homo sapiens
tatggcctcacttta

SEQ ID NO: 488893 - DNA, 15 bp, Homo sapiens
atggcctcactttaa

SEQ ID NO: 488894 - DNA, 15 bp, Homo sapiens
tggcctcactttaaa

SEQ ID NO: 488895 - DNA, 15 bp, Homo sapiens
ggcctcactttaaag

SEQ ID NO: 488896 - DNA, 15 bp, Homo sapiens
gcctcactttaaagg

SEQ ID NO: 488897 - DNA, 15 bp, Homo sapiens
cctcactttaaaggc

SEQ ID NO: 488898 - DNA, 15 bp, Homo sapiens
ctcactttaaaggca

SEQ ID NO: 488899 - DNA, 15 bp, Homo sapiens
tcactttaaaggcaa

SEQ ID NO: 488900 - DNA, 15 bp, Homo sapiens
cactttaaaggcaag

SEQ ID NO: 488901 - DNA, 15 bp, Homo sapiens
actttaaaggcaagt

SEQ ID NO: 488902 - DNA, 15 bp, Homo sapiens
ctttaaaggcaagta

SEQ ID NO: 488903 - DNA, 15 bp, Homo sapiens
tttaaaggcaagtat

SEQ ID NO: 488904 - DNA, 15 bp, Homo sapiens
ttaaaggcaagtata

SEQ ID NO: 488905 - DNA, 15 bp, Homo sapiens
taaaggcaagtataa

SEQ ID NO: 488906 - DNA, 15 bp, Homo sapiens
aaaggcaagtataaa

SEQ ID NO: 488907 - DNA, 15 bp, Homo sapiens
aaggcaagtataaaa

SEQ ID NO: 488908 - DNA, 15 bp, Homo sapiens
aggcaagtataaaat

SEQ ID NO: 488909 - DNA, 15 bp, Homo sapiens
ggcaagtataaaatt

SEQ ID NO: 488910 - DNA, 15 bp, Homo sapiens
gcaagtataaaattc

SEQ ID NO: 488911 - DNA, 15 bp, Homo sapiens
caagtataaaattcc

SEQ ID NO: 488912 - DNA, 15 bp, Homo sapiens
aagtataaaattcct

SEQ ID NO: 488913 - DNA, 15 bp, Homo sapiens
agtataaaattccta

SEQ ID NO: 488914 - DNA, 15 bp, Homo sapiens
gtataaaattcctat

SEQ ID NO: 488915 - DNA, 15 bp, Homo sapiens
tataaaattcctatt

SEQ ID NO: 488916 - DNA, 15 bp, Homo sapiens
ataaaattcctattg

SEQ ID NO: 488917 - DNA, 15 bp, Homo sapiens
taaaattcctattgg

SEQ ID NO: 488918 - DNA, 15 bp, Homo sapiens
aaaattcctattggt

SEQ ID NO: 488919 - DNA, 15 bp, Homo sapiens
aaattcctattggtt

SEQ ID NO: 488920 - DNA, 15 bp, Homo sapiens
aattcctattggttg

SEQ ID NO: 488921 - DNA, 15 bp, Homo sapiens
attcctattggttgg

SEQ ID NO: 488922 - DNA, 15 bp, Homo sapiens
ttcctattggttggg

SEQ ID NO: 488923 - DNA, 15 bp, Homo sapiens
tcctattggttgggg

SEQ ID NO: 488924 - DNA, 15 bp, Homo sapiens
cctattggttgggga

SEQ ID NO: 488925 - DNA, 15 bp, Homo sapiens
ctattggttggggat

SEQ ID NO: 488926 - DNA, 15 bp, Homo sapiens
tattggttggggatc

SEQ ID NO: 488927 - DNA, 15 bp, Homo sapiens
attggttggggatct

SEQ ID NO: 488928 - DNA, 15 bp, Homo sapiens
ttggttggggatctt

SEQ ID NO: 488929 - DNA, 15 bp, Homo sapiens
tggttggggatcttg

SEQ ID NO: 488930 - DNA, 15 bp, Homo sapiens
ggttggggatcttgt

SEQ ID NO: 488931 - DNA, 15 bp, Homo sapiens
gttggggatcttgtt

SEQ ID NO: 488932 - DNA, 15 bp, Homo sapiens
ttggggatcttgtta

SEQ ID NO: 488933 - DNA, 15 bp, Homo sapiens
tggggatcttgttag

SEQ ID NO: 488934 - DNA, 15 bp, Homo sapiens
ggggatcttgttagc

SEQ ID NO: 488935 - DNA, 15 bp, Homo sapiens
gggatcttgttagct

SEQ ID NO: 488936 - DNA, 15 bp, Homo sapiens
ggatcttgttagctg

SEQ ID NO: 488937 - DNA, 15 bp, Homo sapiens
gatcttgttagctgt

SEQ ID NO: 488938 - DNA, 15 bp, Homo sapiens
atcttgttagctgtt

SEQ ID NO: 488939 - DNA, 15 bp, Homo sapiens
tcttgttagctgttc

SEQ ID NO: 488940 - DNA, 15 bp, Homo sapiens
cttgttagctgttca

SEQ ID NO: 488941 - DNA, 15 bp, Homo sapiens
ttgttagctgttcat

SEQ ID NO: 488942 - DNA, 15 bp, Homo sapiens
tgttagctgttcatt

SEQ ID NO: 488943 - DNA, 15 bp, Homo sapiens
gttagctgttcattg

SEQ ID NO: 488944 - DNA, 15 bp, Homo sapiens
ttagctgttcattga

SEQ ID NO: 488945 - DNA, 15 bp, Homo sapiens
tagctgttcattgat

SEQ ID NO: 488946 - DNA, 15 bp, Homo sapiens
agctgttcattgata

SEQ ID NO: 488947 - DNA, 15 bp, Homo sapiens
gctgttcattgatat

SEQ ID NO: 488948 - DNA, 15 bp, Homo sapiens
ctgttcattgatatt

SEQ ID NO: 488949 - DNA, 15 bp, Homo sapiens
tgttcattgatattg

SEQ ID NO: 488950 - DNA, 15 bp, Homo sapiens
gttcattgatattgg

SEQ ID NO: 488951 - DNA, 15 bp, Homo sapiens
ttcattgatattggt

SEQ ID NO: 488952 - DNA, 15 bp, Homo sapiens
tcattgatattggtt

SEQ ID NO: 488953 - DNA, 15 bp, Homo sapiens
cattgatattggttt

SEQ ID NO: 488954 - DNA, 15 bp, Homo sapiens
attgatattggtttc

SEQ ID NO: 488955 - DNA, 15 bp, Homo sapiens
ttgatattggtttct

SEQ ID NO: 488956 - DNA, 15 bp, Homo sapiens
tgatattggtttctg

SEQ ID NO: 488957 - DNA, 15 bp, Homo sapiens
gatattggtttctga

SEQ ID NO: 488958 - DNA, 15 bp, Homo sapiens
atattggtttctgag

SEQ ID NO: 488959 - DNA, 15 bp, Homo sapiens
tattggtttctgaga

SEQ ID NO: 488960 - DNA, 15 bp, Homo sapiens
attggtttctgagag

SEQ ID NO: 488961 - DNA, 15 bp, Homo sapiens
ttggtttctgagagg

SEQ ID NO: 488962 - DNA, 15 bp, Homo sapiens
tggtttctgagagga

SEQ ID NO: 488963 - DNA, 15 bp, Homo sapiens
ggtttctgagaggag

SEQ ID NO: 488964 - DNA, 15 bp, Homo sapiens
gtttctgagaggagt

SEQ ID NO: 488965 - DNA, 15 bp, Homo sapiens
tttctgagaggagta

SEQ ID NO: 488966 - DNA, 15 bp, Homo sapiens
ttctgagaggagtat

SEQ ID NO: 488967 - DNA, 15 bp, Homo sapiens
tctgagaggagtata

SEQ ID NO: 488968 - DNA, 15 bp, Homo sapiens
ctgagaggagtatac

SEQ ID NO: 488969 - DNA, 15 bp, Homo sapiens
tgagaggagtataca

SEQ ID NO: 488970 - DNA, 15 bp, Homo sapiens
gagaggagtatacac

SEQ ID NO: 488971 - DNA, 15 bp, Homo sapiens
agaggagtatacaca

SEQ ID NO: 488972 - DNA, 15 bp, Homo sapiens
gaggagtatacacag

SEQ ID NO: 488973 - DNA, 15 bp, Homo sapiens
aggagtatacacagt

SEQ ID NO: 488974 - DNA, 15 bp, Homo sapiens
ggagtatacacagta

SEQ ID NO: 488975 - DNA, 15 bp, Homo sapiens
gagtatacacagtac

SEQ ID NO: 488976 - DNA, 15 bp, Homo sapiens
agtatacacagtacc

SEQ ID NO: 488977 - DNA, 15 bp, Homo sapiens
gtatacacagtacct

SEQ ID NO: 488978 - DNA, 15 bp, Homo sapiens
tatacacagtacctt

SEQ ID NO: 488979 - DNA, 15 bp, Homo sapiens
atacacagtaccttc

SEQ ID NO: 488980 - DNA, 15 bp, Homo sapiens
tacacagtaccttca

SEQ ID NO: 488981 - DNA, 15 bp, Homo sapiens
acacagtaccttcaa

SEQ ID NO: 488982 - DNA, 15 bp, Homo sapiens
cacagtaccttcaat

SEQ ID NO: 488983 - DNA, 15 bp, Homo sapiens
acagtaccttcaatg

SEQ ID NO: 488984 - DNA, 15 bp, Homo sapiens
cagtaccttcaatgg

SEQ ID NO: 488985 - DNA, 15 bp, Homo sapiens
agtaccttcaatggg

SEQ ID NO: 488986 - DNA, 15 bp, Homo sapiens
gtaccttcaatggga

SEQ ID NO: 488987 - DNA, 15 bp, Homo sapiens
taccttcaatgggac

SEQ ID NO: 488988 - DNA, 15 bp, Homo sapiens
accttcaatgggacc

SEQ ID NO: 488989 - DNA, 15 bp, Homo sapiens
ccttcaatgggaccc

SEQ ID NO: 488990 - DNA, 15 bp, Homo sapiens
cttcaatgggaccca

SEQ ID NO: 488991 - DNA, 15 bp, Homo sapiens
ttcaatgggacccac

SEQ ID NO: 488992 - DNA, 15 bp, Homo sapiens
tcaatgggacccaca

SEQ ID NO: 488993 - DNA, 15 bp, Homo sapiens
caatgggacccacat

SEQ ID NO: 488994 - DNA, 15 bp, Homo sapiens
aatgggacccacatc

SEQ ID NO: 488995 - DNA, 15 bp, Homo sapiens
atgggacccacatca

SEQ ID NO: 488996 - DNA, 15 bp, Homo sapiens
tgggacccacatcac

SEQ ID NO: 488997 - DNA, 15 bp, Homo sapiens
gggacccacatcaca

SEQ ID NO: 488998 - DNA, 15 bp, Homo sapiens
ggacccacatcacag

SEQ ID NO: 488999 - DNA, 15 bp, Homo sapiens
gacccacatcacaga

SEQ ID NO: 489000 - DNA, 15 bp, Homo sapiens
acccacatcacagag

SEQ ID NO: 489001 - DNA, 15 bp, Homo sapiens
cccacatcacagaga

SEQ ID NO: 489002 - DNA, 15 bp, Homo sapiens
ccacatcacagagat

SEQ ID NO: 489003 - DNA, 15 bp, Homo sapiens
cacatcacagagatt

SEQ ID NO: 489004 - DNA, 15 bp, Homo sapiens
acatcacagagattc

SEQ ID NO: 489005 - DNA, 15 bp, Homo sapiens
catcacagagattca

SEQ ID NO: 489006 - DNA, 15 bp, Homo sapiens
atcacagagattcat

SEQ ID NO: 489007 - DNA, 15 bp, Homo sapiens
tcacagagattcatc

SEQ ID NO: 489008 - DNA, 15 bp, Homo sapiens
cacagagattcatcc

SEQ ID NO: 489009 - DNA, 15 bp, Homo sapiens
acagagattcatcct

SEQ ID NO: 489010 - DNA, 15 bp, Homo sapiens
cagagattcatcctc

SEQ ID NO: 489011 - DNA, 15 bp, Homo sapiens
agagattcatcctct

SEQ ID NO: 489012 - DNA, 15 bp, Homo sapiens
gagattcatcctctc

SEQ ID NO: 489013 - DNA, 15 bp, Homo sapiens
agattcatcctctcc

SEQ ID NO: 489014 - DNA, 15 bp, Homo sapiens
gattcatcctctccc

SEQ ID NO: 489015 - DNA, 15 bp, Homo sapiens
attcatcctctcccc

SEQ ID NO: 489016 - DNA, 15 bp, Homo sapiens
ttcatcctctcccct

SEQ ID NO: 489017 - DNA, 15 bp, Homo sapiens
tcatcctctcccctg

SEQ ID NO: 489018 - DNA, 15 bp, Homo sapiens
catcctctcccctgc

SEQ ID NO: 489019 - DNA, 15 bp, Homo sapiens
atcctctcccctgca

SEQ ID NO: 489020 - DNA, 15 bp, Homo sapiens
tcctctcccctgcat

SEQ ID NO: 489021 - DNA, 15 bp, Homo sapiens
cctctcccctgcatt

SEQ ID NO: 489022 - DNA, 15 bp, Homo sapiens
ctctcccctgcattg

SEQ ID NO: 489023 - DNA, 15 bp, Homo sapiens
tctcccctgcattgg

SEQ ID NO: 489024 - DNA, 15 bp, Homo sapiens
ctcccctgcattggt

SEQ ID NO: 489025 - DNA, 15 bp, Homo sapiens
tcccctgcattggtc

SEQ ID NO: 489026 - DNA, 15 bp, Homo sapiens
cccctgcattggtcc

SEQ ID NO: 489027 - DNA, 15 bp, Homo sapiens
ccctgcattggtccc

SEQ ID NO: 489028 - DNA, 15 bp, Homo sapiens
cctgcattggtcccc

SEQ ID NO: 489029 - DNA, 15 bp, Homo sapiens
ctgcattggtcccct

SEQ ID NO: 489030 - DNA, 15 bp, Homo sapiens
tgcattggtcccctc

SEQ ID NO: 489031 - DNA, 15 bp, Homo sapiens
gcattggtcccctct

SEQ ID NO: 489032 - DNA, 15 bp, Homo sapiens
cattggtcccctctt

SEQ ID NO: 489033 - DNA, 15 bp, Homo sapiens
attggtcccctcttc

SEQ ID NO: 489034 - DNA, 15 bp, Homo sapiens
ttggtcccctcttca

SEQ ID NO: 489035 - DNA, 15 bp, Homo sapiens
tggtcccctcttcac

SEQ ID NO: 489036 - DNA, 15 bp, Homo sapiens
ggtcccctcttcacc

SEQ ID NO: 489037 - DNA, 15 bp, Homo sapiens
gtcccctcttcacca

SEQ ID NO: 489038 - DNA, 15 bp, Homo sapiens
tcccctcttcaccaa

SEQ ID NO: 489039 - DNA, 15 bp, Homo sapiens
cccctcttcaccaat

SEQ ID NO: 489040 - DNA, 15 bp, Homo sapiens
ccctcttcaccaatg

SEQ ID NO: 489041 - DNA, 15 bp, Homo sapiens
cctcttcaccaatgt

SEQ ID NO: 489042 - DNA, 15 bp, Homo sapiens
ctcttcaccaatgtc

SEQ ID NO: 489043 - DNA, 15 bp, Homo sapiens
tcttcaccaatgtca

SEQ ID NO: 489044 - DNA, 15 bp, Homo sapiens
cttcaccaatgtcat

SEQ ID NO: 489045 - DNA, 15 bp, Homo sapiens
ttcaccaatgtcatt

SEQ ID NO: 489046 - DNA, 15 bp, Homo sapiens
tcaccaatgtcattc

SEQ ID NO: 489047 - DNA, 15 bp, Homo sapiens
caccaatgtcattct

SEQ ID NO: 489048 - DNA, 15 bp, Homo sapiens
accaatgtcattctc

SEQ ID NO: 489049 - DNA, 15 bp, Homo sapiens
ccaatgtcattctca

SEQ ID NO: 489050 - DNA, 15 bp, Homo sapiens
caatgtcattctcag

SEQ ID NO: 489051 - DNA, 15 bp, Homo sapiens
aatgtcattctcagt

SEQ ID NO: 489052 - DNA, 15 bp, Homo sapiens
atgtcattctcagtg

SEQ ID NO: 489053 - DNA, 15 bp, Homo sapiens
tgtcattctcagtgt

SEQ ID NO: 489054 - DNA, 15 bp, Homo sapiens
gtcattctcagtgtt

SEQ ID NO: 489055 - DNA, 15 bp, Homo sapiens
tcattctcagtgttc

SEQ ID NO: 489056 - DNA, 15 bp, Homo sapiens
cattctcagtgttca

SEQ ID NO: 489057 - DNA, 15 bp, Homo sapiens
attctcagtgttcag

SEQ ID NO: 489058 - DNA, 15 bp, Homo sapiens
ttctcagtgttcaga

SEQ ID NO: 489059 - DNA, 15 bp, Homo sapiens
tctcagtgttcagag

SEQ ID NO: 489060 - DNA, 15 bp, Homo sapiens
ctcagtgttcagaga

SEQ ID NO: 489061 - DNA, 15 bp, Homo sapiens
tcagtgttcagagag

SEQ ID NO: 489062 - DNA, 15 bp, Homo sapiens
cagtgttcagagagt

SEQ ID NO: 489063 - DNA, 15 bp, Homo sapiens
agtgttcagagagtg

SEQ ID NO: 489064 - DNA, 15 bp, Homo sapiens
gtgttcagagagtgg

SEQ ID NO: 489065 - DNA, 15 bp, Homo sapiens
tgttcagagagtggt

SEQ ID NO: 489066 - DNA, 15 bp, Homo sapiens
gttcagagagtggtt

SEQ ID NO: 489067 - DNA, 15 bp, Homo sapiens
ttcagagagtggttt

SEQ ID NO: 489068 - DNA, 15 bp, Homo sapiens
tcagagagtggttta

SEQ ID NO: 489069 - DNA, 15 bp, Homo sapiens
cagagagtggtttat

SEQ ID NO: 489070 - DNA, 15 bp, Homo sapiens
agagagtggtttatg

SEQ ID NO: 489071 - DNA, 15 bp, Homo sapiens
gagagtggtttatgg

SEQ ID NO: 489072 - DNA, 15 bp, Homo sapiens
agagtggtttatgga

SEQ ID NO: 489073 - DNA, 15 bp, Homo sapiens
gagtggtttatggag

SEQ ID NO: 489074 - DNA, 15 bp, Homo sapiens
agtggtttatggagc

SEQ ID NO: 489075 - DNA, 15 bp, Homo sapiens
gtggtttatggagcc

SEQ ID NO: 489076 - DNA, 15 bp, Homo sapiens
tggtttatggagccc

SEQ ID NO: 489077 - DNA, 15 bp, Homo sapiens
ggtttatggagccct

SEQ ID NO: 489078 - DNA, 15 bp, Homo sapiens
gtttatggagccctg

SEQ ID NO: 489079 - DNA, 15 bp, Homo sapiens
tttatggagccctga

SEQ ID NO: 489080 - DNA, 15 bp, Homo sapiens
ttatggagccctgag

SEQ ID NO: 489081 - DNA, 15 bp, Homo sapiens
tatggagccctgaga

SEQ ID NO: 489082 - DNA, 15 bp, Homo sapiens
atggagccctgagat

SEQ ID NO: 489083 - DNA, 15 bp, Homo sapiens
tggagccctgagatt

SEQ ID NO: 489084 - DNA, 15 bp, Homo sapiens
ggagccctgagattc

SEQ ID NO: 489085 - DNA, 15 bp, Homo sapiens
gagccctgagattcc

SEQ ID NO: 489086 - DNA, 15 bp, Homo sapiens
agccctgagattcct

SEQ ID NO: 489087 - DNA, 15 bp, Homo sapiens
gccctgagattcctt

SEQ ID NO: 489088 - DNA, 15 bp, Homo sapiens
ccctgagattcctta

SEQ ID NO: 489089 - DNA, 15 bp, Homo sapiens
cctgagattccttaa

SEQ ID NO: 489090 - DNA, 15 bp, Homo sapiens
ctgagattccttaat

SEQ ID NO: 489091 - DNA, 15 bp, Homo sapiens
tgagattccttaatg

SEQ ID NO: 489092 - DNA, 15 bp, Homo sapiens
gagattccttaatgt

SEQ ID NO: 489093 - DNA, 15 bp, Homo sapiens
agattccttaatgtt

SEQ ID NO: 489094 - DNA, 15 bp, Homo sapiens
gattccttaatgttt

SEQ ID NO: 489095 - DNA, 15 bp, Homo sapiens
attccttaatgttta

SEQ ID NO: 489096 - DNA, 15 bp, Homo sapiens
ttccttaatgtttat

SEQ ID NO: 489097 - DNA, 15 bp, Homo sapiens
tccttaatgtttatt

SEQ ID NO: 489098 - DNA, 15 bp, Homo sapiens
ccttaatgtttatta

SEQ ID NO: 489099 - DNA, 15 bp, Homo sapiens
cttaatgtttattaa

SEQ ID NO: 489100 - DNA, 15 bp, Homo sapiens
ttaatgtttattaag

SEQ ID NO: 489101 - DNA, 15 bp, Homo sapiens
taatgtttattaagc

SEQ ID NO: 489102 - DNA, 15 bp, Homo sapiens
aatgtttattaagct

SEQ ID NO: 489103 - DNA, 15 bp, Homo sapiens
atgtttattaagctt

SEQ ID NO: 489104 - DNA, 15 bp, Homo sapiens
tgtttattaagcttg

SEQ ID NO: 489105 - DNA, 15 bp, Homo sapiens
gtttattaagcttga

SEQ ID NO: 489106 - DNA, 15 bp, Homo sapiens
tttattaagcttgag

SEQ ID NO: 489107 - DNA, 15 bp, Homo sapiens
ttattaagcttgagt

SEQ ID NO: 489108 - DNA, 15 bp, Homo sapiens
tattaagcttgagtc

SEQ ID NO: 489109 - DNA, 15 bp, Homo sapiens
attaagcttgagtca

SEQ ID NO: 489110 - DNA, 15 bp, Homo sapiens
ttaagcttgagtcac

SEQ ID NO: 489111 - DNA, 15 bp, Homo sapiens
taagcttgagtcaca

SEQ ID NO: 489112 - DNA, 15 bp, Homo sapiens
aagcttgagtcacat

SEQ ID NO: 489113 - DNA, 15 bp, Homo sapiens
agcttgagtcacatt

SEQ ID NO: 489114 - DNA, 15 bp, Homo sapiens
gcttgagtcacattc

SEQ ID NO: 489115 - DNA, 15 bp, Homo sapiens
cttgagtcacattcg

SEQ ID NO: 489116 - DNA, 15 bp, Homo sapiens
ttgagtcacattcgt

SEQ ID NO: 489117 - DNA, 15 bp, Homo sapiens
tgagtcacattcgtc

SEQ ID NO: 489118 - DNA, 15 bp, Homo sapiens
gagtcacattcgtca

SEQ ID NO: 489119 - DNA, 15 bp, Homo sapiens
agtcacattcgtcaa

SEQ ID NO: 489120 - DNA, 15 bp, Homo sapiens
gtcacattcgtcaaa

SEQ ID NO: 489121 - DNA, 15 bp, Homo sapiens
tcacattcgtcaaaa

SEQ ID NO: 489122 - DNA, 15 bp, Homo sapiens
cacattcgtcaaaaa

SEQ ID NO: 489123 - DNA, 15 bp, Homo sapiens
acattcgtcaaaaac

SEQ ID NO: 489124 - DNA, 15 bp, Homo sapiens
cattcgtcaaaaact

SEQ ID NO: 489125 - DNA, 15 bp, Homo sapiens
attcgtcaaaaactc

SEQ ID NO: 489126 - DNA, 15 bp, Homo sapiens
ttcgtcaaaaactca

SEQ ID NO: 489127 - DNA, 15 bp, Homo sapiens
tcgtcaaaaactcaa

SEQ ID NO: 489128 - DNA, 15 bp, Homo sapiens
cgtcaaaaactcaaa

SEQ ID NO: 489129 - DNA, 15 bp, Homo sapiens
gtcaaaaactcaaaa

SEQ ID NO: 489130 - DNA, 15 bp, Homo sapiens
tcaaaaactcaaaac

SEQ ID NO: 489131 - DNA, 15 bp, Homo sapiens
caaaaactcaaaacc

SEQ ID NO: 489132 - DNA, 15 bp, Homo sapiens
aaaaactcaaaacct

SEQ ID NO: 489133 - DNA, 15 bp, Homo sapiens
aaaactcaaaaccta

SEQ ID NO: 489134 - DNA, 15 bp, Homo sapiens
aaactcaaaacctac

SEQ ID NO: 489135 - DNA, 15 bp, Homo sapiens
aactcaaaacctact

SEQ ID NO: 489136 - DNA, 15 bp, Homo sapiens
actcaaaacctactg

SEQ ID NO: 489137 - DNA, 15 bp, Homo sapiens
ctcaaaacctactga

SEQ ID NO: 489138 - DNA, 15 bp, Homo sapiens
tcaaaacctactgaa

SEQ ID NO: 489139 - DNA, 15 bp, Homo sapiens
caaaacctactgaaa

SEQ ID NO: 489140 - DNA, 15 bp, Homo sapiens
aaaacctactgaaat

SEQ ID NO: 489141 - DNA, 15 bp, Homo sapiens
aaacctactgaaatg

SEQ ID NO: 489142 - DNA, 15 bp, Homo sapiens
aacctactgaaatgc

SEQ ID NO: 489143 - DNA, 15 bp, Homo sapiens
acctactgaaatgca

SEQ ID NO: 489144 - DNA, 15 bp, Homo sapiens
cctactgaaatgcaa

SEQ ID NO: 489145 - DNA, 15 bp, Homo sapiens
ctactgaaatgcaat

SEQ ID NO: 489146 - DNA, 15 bp, Homo sapiens
tactgaaatgcaatg

SEQ ID NO: 489147 - DNA, 15 bp, Homo sapiens
actgaaatgcaatga

SEQ ID NO: 489148 - DNA, 15 bp, Homo sapiens
ctgaaatgcaatgat

SEQ ID NO: 489149 - DNA, 15 bp, Homo sapiens
tgaaatgcaatgatt

SEQ ID NO: 489150 - DNA, 15 bp, Homo sapiens
gaaatgcaatgattt

SEQ ID NO: 489151 - DNA, 15 bp, Homo sapiens
aaatgcaatgatttc

SEQ ID NO: 489152 - DNA, 15 bp, Homo sapiens
aatgcaatgatttcc

SEQ ID NO: 489153 - DNA, 15 bp, Homo sapiens
atgcaatgatttcct

SEQ ID NO: 489154 - DNA, 15 bp, Homo sapiens
tgcaatgatttcctt

SEQ ID NO: 489155 - DNA, 15 bp, Homo sapiens
gcaatgatttccttt

SEQ ID NO: 489156 - DNA, 15 bp, Homo sapiens
caatgatttcctttt

SEQ ID NO: 489157 - DNA, 15 bp, Homo sapiens
aatgatttcctttta

SEQ ID NO: 489158 - DNA, 15 bp, Homo sapiens
atgatttccttttaa

SEQ ID NO: 489159 - DNA, 15 bp, Homo sapiens
tgatttccttttaaa

SEQ ID NO: 489160 - DNA, 15 bp, Homo sapiens
gatttccttttaaat

SEQ ID NO: 489161 - DNA, 15 bp, Homo sapiens
atttccttttaaata

SEQ ID NO: 489162 - DNA, 15 bp, Homo sapiens
tttccttttaaatat

SEQ ID NO: 489163 - DNA, 15 bp, Homo sapiens
ttccttttaaatatg

SEQ ID NO: 489164 - DNA, 15 bp, Homo sapiens
tccttttaaatatgt

SEQ ID NO: 489165 - DNA, 15 bp, Homo sapiens
ccttttaaatatgtt

SEQ ID NO: 489166 - DNA, 15 bp, Homo sapiens
cttttaaatatgttt

SEQ ID NO: 489167 - DNA, 15 bp, Homo sapiens
ttttaaatatgtttg

SEQ ID NO: 489168 - DNA, 15 bp, Homo sapiens
tttaaatatgtttgt

SEQ ID NO: 489169 - DNA, 15 bp, Homo sapiens
ttaaatatgtttgta

SEQ ID NO: 489170 - DNA, 15 bp, Homo sapiens
taaatatgtttgtat

SEQ ID NO: 489171 - DNA, 15 bp, Homo sapiens
aaatatgtttgtatg

SEQ ID NO: 489172 - DNA, 15 bp, Homo sapiens
aatatgtttgtatgt

SEQ ID NO: 489173 - DNA, 15 bp, Homo sapiens
atatgtttgtatgta

SEQ ID NO: 489174 - DNA, 15 bp, Homo sapiens
tatgtttgtatgtaa

SEQ ID NO: 489175 - DNA, 15 bp, Homo sapiens
atgtttgtatgtaaa

SEQ ID NO: 489176 - DNA, 15 bp, Homo sapiens
tgtttgtatgtaaaa

SEQ ID NO: 489177 - DNA, 15 bp, Homo sapiens
gtttgtatgtaaaat

SEQ ID NO: 489178 - DNA, 15 bp, Homo sapiens
tttgtatgtaaaata

SEQ ID NO: 489179 - DNA, 15 bp, Homo sapiens
ttgtatgtaaaatac

SEQ ID NO: 489180 - DNA, 15 bp, Homo sapiens
tgtatgtaaaatacc

SEQ ID NO: 489181 - DNA, 15 bp, Homo sapiens
gtatgtaaaataccc

SEQ ID NO: 489182 - DNA, 15 bp, Homo sapiens
tatgtaaaataccct

SEQ ID NO: 489183 - DNA, 15 bp, Homo sapiens
atgtaaaataccctt

SEQ ID NO: 489184 - DNA, 15 bp, Homo sapiens
tgtaaaataccctta

SEQ ID NO: 489185 - DNA, 15 bp, Homo sapiens
gtaaaatacccttag

SEQ ID NO: 489186 - DNA, 15 bp, Homo sapiens
taaaatacccttagc

SEQ ID NO: 489187 - DNA, 15 bp, Homo sapiens
aaaatacccttagcc

SEQ ID NO: 489188 - DNA, 15 bp, Homo sapiens
aaatacccttagcct

SEQ ID NO: 489189 - DNA, 15 bp, Homo sapiens
aatacccttagcctt

SEQ ID NO: 489190 - DNA, 15 bp, Homo sapiens
atacccttagccttc

SEQ ID NO: 489191 - DNA, 15 bp, Homo sapiens
tacccttagccttct

SEQ ID NO: 489192 - DNA, 15 bp, Homo sapiens
acccttagccttcta

SEQ ID NO: 489193 - DNA, 15 bp, Homo sapiens
cccttagccttctat

SEQ ID NO: 489194 - DNA, 15 bp, Homo sapiens
ccttagccttctatc

SEQ ID NO: 489195 - DNA, 15 bp, Homo sapiens
cttagccttctatct

SEQ ID NO: 489196 - DNA, 15 bp, Homo sapiens
ttagccttctatctg

SEQ ID NO: 489197 - DNA, 15 bp, Homo sapiens
tagccttctatctga

SEQ ID NO: 489198 - DNA, 15 bp, Homo sapiens
agccttctatctgat

SEQ ID NO: 489199 - DNA, 15 bp, Homo sapiens
gccttctatctgata

SEQ ID NO: 489200 - DNA, 15 bp, Homo sapiens
ccttctatctgataa

SEQ ID NO: 489201 - DNA, 15 bp, Homo sapiens
cttctatctgataaa

SEQ ID NO: 489202 - DNA, 15 bp, Homo sapiens
ttctatctgataaaa

SEQ ID NO: 489203 - DNA, 15 bp, Homo sapiens
tctatctgataaaaa

SEQ ID NO: 489204 - DNA, 15 bp, Homo sapiens
ctatctgataaaaag

SEQ ID NO: 489205 - DNA, 15 bp, Homo sapiens
tatctgataaaaagc

SEQ ID NO: 489206 - DNA, 15 bp, Homo sapiens
atctgataaaaagct

SEQ ID NO: 489207 - DNA, 15 bp, Homo sapiens
tctgataaaaagctg

SEQ ID NO: 489208 - DNA, 15 bp, Homo sapiens
ctgataaaaagctgt

SEQ ID NO: 489209 - DNA, 15 bp, Homo sapiens
tgataaaaagctgtt

SEQ ID NO: 489210 - DNA, 15 bp, Homo sapiens
gataaaaagctgttg

SEQ ID NO: 489211 - DNA, 15 bp, Homo sapiens
ataaaaagctgttgg

SEQ ID NO: 489212 - DNA, 15 bp, Homo sapiens
taaaaagctgttggt

SEQ ID NO: 489213 - DNA, 15 bp, Homo sapiens
aaaaagctgttggtt

SEQ ID NO: 489214 - DNA, 15 bp, Homo sapiens
aaaagctgttggttt

SEQ ID NO: 489215 - DNA, 15 bp, Homo sapiens
aaagctgttggttta

SEQ ID NO: 489216 - DNA, 15 bp, Homo sapiens
aagctgttggtttaa

SEQ ID NO: 489217 - DNA, 15 bp, Homo sapiens
agctgttggtttaaa

SEQ ID NO: 489218 - DNA, 15 bp, Homo sapiens
gctgttggtttaaaa

SEQ ID NO: 489219 - DNA, 15 bp, Homo sapiens
ctgttggtttaaaag

SEQ ID NO: 489220 - DNA, 15 bp, Homo sapiens
tgttggtttaaaagt

SEQ ID NO: 489221 - DNA, 15 bp, Homo sapiens
gttggtttaaaagta

SEQ ID NO: 489222 - DNA, 15 bp, Homo sapiens
ttggtttaaaagtat

SEQ ID NO: 489223 - DNA, 15 bp, Homo sapiens
tggtttaaaagtatt

SEQ ID NO: 489224 - DNA, 15 bp, Homo sapiens
ggtttaaaagtattg

SEQ ID NO: 489225 - DNA, 15 bp, Homo sapiens
gtttaaaagtattgg

SEQ ID NO: 489226 - DNA, 15 bp, Homo sapiens
tttaaaagtattggt

SEQ ID NO: 489227 - DNA, 15 bp, Homo sapiens
ttaaaagtattggtt

SEQ ID NO: 489228 - DNA, 15 bp, Homo sapiens
taaaagtattggttt

SEQ ID NO: 489229 - DNA, 15 bp, Homo sapiens
aaaagtattggtttg

SEQ ID NO: 489230 - DNA, 15 bp, Homo sapiens
aaagtattggtttgg

SEQ ID NO: 489231 - DNA, 15 bp, Homo sapiens
aagtattggtttgga

SEQ ID NO: 489232 - DNA, 15 bp, Homo sapiens
agtattggtttggag

SEQ ID NO: 489233 - DNA, 15 bp, Homo sapiens
gtattggtttggagc

SEQ ID NO: 489234 - DNA, 15 bp, Homo sapiens
tattggtttggagca

SEQ ID NO: 489235 - DNA, 15 bp, Homo sapiens
attggtttggagcag

SEQ ID NO: 489236 - DNA, 15 bp, Homo sapiens
ttggtttggagcagc

SEQ ID NO: 489237 - DNA, 15 bp, Homo sapiens
tggtttggagcagct

SEQ ID NO: 489238 - DNA, 15 bp, Homo sapiens
ggtttggagcagctg

SEQ ID NO: 489239 - DNA, 15 bp, Homo sapiens
gtttggagcagctgg

SEQ ID NO: 489240 - DNA, 15 bp, Homo sapiens
tttggagcagctggc

SEQ ID NO: 489241 - DNA, 15 bp, Homo sapiens
ttggagcagctggct

SEQ ID NO: 489242 - DNA, 15 bp, Homo sapiens
tggagcagctggctt

SEQ ID NO: 489243 - DNA, 15 bp, Homo sapiens
ggagcagctggcttc

SEQ ID NO: 489244 - DNA, 15 bp, Homo sapiens
gagcagctggcttca

SEQ ID NO: 489245 - DNA, 15 bp, Homo sapiens
agcagctggcttcat

SEQ ID NO: 489246 - DNA, 15 bp, Homo sapiens
gcagctggcttcatg

SEQ ID NO: 489247 - DNA, 15 bp, Homo sapiens
cagctggcttcatgt

SEQ ID NO: 489248 - DNA, 15 bp, Homo sapiens
agctggcttcatgtt

SEQ ID NO: 489249 - DNA, 15 bp, Homo sapiens
gctggcttcatgttt

SEQ ID NO: 489250 - DNA, 15 bp, Homo sapiens
ctggcttcatgtttt

SEQ ID NO: 489251 - DNA, 15 bp, Homo sapiens
tggcttcatgttttc

SEQ ID NO: 489252 - DNA, 15 bp, Homo sapiens
ggcttcatgttttca

SEQ ID NO: 489253 - DNA, 15 bp, Homo sapiens
gcttcatgttttcat

SEQ ID NO: 489254 - DNA, 15 bp, Homo sapiens
cttcatgttttcata

SEQ ID NO: 489255 - DNA, 15 bp, Homo sapiens
ttcatgttttcatag

SEQ ID NO: 489256 - DNA, 15 bp, Homo sapiens
tcatgttttcatagt

SEQ ID NO: 489257 - DNA, 15 bp, Homo sapiens
catgttttcatagtg

SEQ ID NO: 489258 - DNA, 15 bp, Homo sapiens
atgttttcatagtgt

SEQ ID NO: 489259 - DNA, 15 bp, Homo sapiens
tgttttcatagtgtt

SEQ ID NO: 489260 - DNA, 15 bp, Homo sapiens
gttttcatagtgtta

SEQ ID NO: 489261 - DNA, 15 bp, Homo sapiens
ttttcatagtgttaa

SEQ ID NO: 489262 - DNA, 15 bp, Homo sapiens
tttcatagtgttaac

SEQ ID NO: 489263 - DNA, 15 bp, Homo sapiens
ttcatagtgttaact

SEQ ID NO: 489264 - DNA, 15 bp, Homo sapiens
tcatagtgttaacta

SEQ ID NO: 489265 - DNA, 15 bp, Homo sapiens
catagtgttaactat

SEQ ID NO: 489266 - DNA, 15 bp, Homo sapiens
atagtgttaactatg

SEQ ID NO: 489267 - DNA, 15 bp, Homo sapiens
tagtgttaactatgc

SEQ ID NO: 489268 - DNA, 15 bp, Homo sapiens
agtgttaactatgca

SEQ ID NO: 489269 - DNA, 15 bp, Homo sapiens
gtgttaactatgcac

SEQ ID NO: 489270 - DNA, 15 bp, Homo sapiens
tgttaactatgcaca

SEQ ID NO: 489271 - DNA, 15 bp, Homo sapiens
gttaactatgcacat

SEQ ID NO: 489272 - DNA, 15 bp, Homo sapiens
ttaactatgcacatt

SEQ ID NO: 489273 - DNA, 15 bp, Homo sapiens
taactatgcacattc

SEQ ID NO: 489274 - DNA, 15 bp, Homo sapiens
aactatgcacattca

SEQ ID NO: 489275 - DNA, 15 bp, Homo sapiens
actatgcacattcac

SEQ ID NO: 489276 - DNA, 15 bp, Homo sapiens
ctatgcacattcaca

SEQ ID NO: 489277 - DNA, 15 bp, Homo sapiens
tatgcacattcacaa

SEQ ID NO: 489278 - DNA, 15 bp, Homo sapiens
atgcacattcacaaa

SEQ ID NO: 489279 - DNA, 15 bp, Homo sapiens
tgcacattcacaaat

SEQ ID NO: 489280 - DNA, 15 bp, Homo sapiens
gcacattcacaaata

SEQ ID NO: 489281 - DNA, 15 bp, Homo sapiens
cacattcacaaatat

SEQ ID NO: 489282 - DNA, 15 bp, Homo sapiens
acattcacaaatatt

SEQ ID NO: 489283 - DNA, 15 bp, Homo sapiens
cattcacaaatattt

SEQ ID NO: 489284 - DNA, 15 bp, Homo sapiens
attcacaaatattta

SEQ ID NO: 489285 - DNA, 15 bp, Homo sapiens
ttcacaaatatttat

SEQ ID NO: 489286 - DNA, 15 bp, Homo sapiens
tcacaaatatttata

SEQ ID NO: 489287 - DNA, 15 bp, Homo sapiens
cacaaatatttataa

SEQ ID NO: 489288 - DNA, 15 bp, Homo sapiens
acaaatatttataat

SEQ ID NO: 489289 - DNA, 15 bp, Homo sapiens
caaatatttataata

SEQ ID NO: 489290 - DNA, 15 bp, Homo sapiens
aaatatttataatag

SEQ ID NO: 489291 - DNA, 15 bp, Homo sapiens
aatatttataatagt

SEQ ID NO: 489292 - DNA, 15 bp, Homo sapiens
atatttataatagtc

SEQ ID NO: 489293 - DNA, 15 bp, Homo sapiens
tatttataatagtca

SEQ ID NO: 489294 - DNA, 15 bp, Homo sapiens
atttataatagtcat

SEQ ID NO: 489295 - DNA, 15 bp, Homo sapiens
tttataatagtcata

SEQ ID NO: 489296 - DNA, 15 bp, Homo sapiens
ttataatagtcatag

SEQ ID NO: 489297 - DNA, 15 bp, Homo sapiens
tataatagtcatagt

SEQ ID NO: 489298 - DNA, 15 bp, Homo sapiens
ataatagtcatagtt

SEQ ID NO: 489299 - DNA, 15 bp, Homo sapiens
taatagtcatagttt

SEQ ID NO: 489300 - DNA, 15 bp, Homo sapiens
aatagtcatagtttt

SEQ ID NO: 489301 - DNA, 15 bp, Homo sapiens
atagtcatagttttc

SEQ ID NO: 489302 - DNA, 15 bp, Homo sapiens
tagtcatagttttct

SEQ ID NO: 489303 - DNA, 15 bp, Homo sapiens
agtcatagttttctg

SEQ ID NO: 489304 - DNA, 15 bp, Homo sapiens
gtcatagttttctga

SEQ ID NO: 489305 - DNA, 15 bp, Homo sapiens
tcatagttttctgaa

SEQ ID NO: 489306 - DNA, 15 bp, Homo sapiens
catagttttctgaat

SEQ ID NO: 489307 - DNA, 15 bp, Homo sapiens
atagttttctgaatg

SEQ ID NO: 489308 - DNA, 15 bp, Homo sapiens
tagttttctgaatga

SEQ ID NO: 489309 - DNA, 15 bp, Homo sapiens
agttttctgaatgag

SEQ ID NO: 489310 - DNA, 15 bp, Homo sapiens
gttttctgaatgagc

SEQ ID NO: 489311 - DNA, 15 bp, Homo sapiens
ttttctgaatgagca

SEQ ID NO: 489312 - DNA, 15 bp, Homo sapiens
tttctgaatgagcat

SEQ ID NO: 489313 - DNA, 15 bp, Homo sapiens
ttctgaatgagcatt

SEQ ID NO: 489314 - DNA, 15 bp, Homo sapiens
tctgaatgagcatta

SEQ ID NO: 489315 - DNA, 15 bp, Homo sapiens
ctgaatgagcattac

SEQ ID NO: 489316 - DNA, 15 bp, Homo sapiens
tgaatgagcattact

SEQ ID NO: 489317 - DNA, 15 bp, Homo sapiens
gaatgagcattacta

SEQ ID NO: 489318 - DNA, 15 bp, Homo sapiens
aatgagcattactag

SEQ ID NO: 489319 - DNA, 15 bp, Homo sapiens
atgagcattactagt

SEQ ID NO: 489320 - DNA, 15 bp, Homo sapiens
tgagcattactagtc

SEQ ID NO: 489321 - DNA, 15 bp, Homo sapiens
gagcattactagtca

SEQ ID NO: 489322 - DNA, 15 bp, Homo sapiens
agcattactagtcat

SEQ ID NO: 489323 - DNA, 15 bp, Homo sapiens
gcattactagtcatg

SEQ ID NO: 489324 - DNA, 15 bp, Homo sapiens
cattactagtcatgt

SEQ ID NO: 489325 - DNA, 15 bp, Homo sapiens
attactagtcatgtc

SEQ ID NO: 489326 - DNA, 15 bp, Homo sapiens
ttactagtcatgtct

SEQ ID NO: 489327 - DNA, 15 bp, Homo sapiens
tactagtcatgtctt

SEQ ID NO: 489328 - DNA, 15 bp, Homo sapiens
actagtcatgtcttc

SEQ ID NO: 489329 - DNA, 15 bp, Homo sapiens
ctagtcatgtcttct

SEQ ID NO: 489330 - DNA, 15 bp, Homo sapiens
tagtcatgtcttctt

SEQ ID NO: 489331 - DNA, 15 bp, Homo sapiens
agtcatgtcttcttt

SEQ ID NO: 489332 - DNA, 15 bp, Homo sapiens
gtcatgtcttctttt

SEQ ID NO: 489333 - DNA, 15 bp, Homo sapiens
tcatgtcttcttttc

SEQ ID NO: 489334 - DNA, 15 bp, Homo sapiens
catgtcttcttttca

SEQ ID NO: 489335 - DNA, 15 bp, Homo sapiens
atgtcttcttttcaa

SEQ ID NO: 489336 - DNA, 15 bp, Homo sapiens
tgtcttcttttcaag

SEQ ID NO: 489337 - DNA, 15 bp, Homo sapiens
gtcttcttttcaaga

SEQ ID NO: 489338 - DNA, 15 bp, Homo sapiens
tcttcttttcaagaa

SEQ ID NO: 489339 - DNA, 15 bp, Homo sapiens
cttcttttcaagaat

SEQ ID NO: 489340 - DNA, 15 bp, Homo sapiens
ttcttttcaagaatt

SEQ ID NO: 489341 - DNA, 15 bp, Homo sapiens
tcttttcaagaattc

SEQ ID NO: 489342 - DNA, 15 bp, Homo sapiens
cttttcaagaattca

SEQ ID NO: 489343 - DNA, 15 bp, Homo sapiens
ttttcaagaattcaa

SEQ ID NO: 489344 - DNA, 15 bp, Homo sapiens
tttcaagaattcaag

SEQ ID NO: 489345 - DNA, 15 bp, Homo sapiens
ttcaagaattcaagc

SEQ ID NO: 489346 - DNA, 15 bp, Homo sapiens
tcaagaattcaagca

SEQ ID NO: 489347 - DNA, 15 bp, Homo sapiens
caagaattcaagcac

SEQ ID NO: 489348 - DNA, 15 bp, Homo sapiens
aagaattcaagcaca

SEQ ID NO: 489349 - DNA, 15 bp, Homo sapiens
agaattcaagcacat

SEQ ID NO: 489350 - DNA, 15 bp, Homo sapiens
gaattcaagcacatc

SEQ ID NO: 489351 - DNA, 15 bp, Homo sapiens
aattcaagcacatcc

SEQ ID NO: 489352 - DNA, 15 bp, Homo sapiens
attcaagcacatcca

SEQ ID NO: 489353 - DNA, 15 bp, Homo sapiens
ttcaagcacatccat

SEQ ID NO: 489354 - DNA, 15 bp, Homo sapiens
tcaagcacatccatg

SEQ ID NO: 489355 - DNA, 15 bp, Homo sapiens
caagcacatccatgt

SEQ ID NO: 489356 - DNA, 15 bp, Homo sapiens
aagcacatccatgta

SEQ ID NO: 489357 - DNA, 15 bp, Homo sapiens
agcacatccatgtat

SEQ ID NO: 489358 - DNA, 15 bp, Homo sapiens
gcacatccatgtatg

SEQ ID NO: 489359 - DNA, 15 bp, Homo sapiens
cacatccatgtatga

SEQ ID NO: 489360 - DNA, 15 bp, Homo sapiens
acatccatgtatgaa

SEQ ID NO: 489361 - DNA, 15 bp, Homo sapiens
catccatgtatgaaa

SEQ ID NO: 489362 - DNA, 15 bp, Homo sapiens
atccatgtatgaaat

SEQ ID NO: 489363 - DNA, 15 bp, Homo sapiens
tccatgtatgaaatg

SEQ ID NO: 489364 - DNA, 15 bp, Homo sapiens
ccatgtatgaaatga

SEQ ID NO: 489365 - DNA, 15 bp, Homo sapiens
catgtatgaaatgat

SEQ ID NO: 489366 - DNA, 15 bp, Homo sapiens
atgtatgaaatgatg

SEQ ID NO: 489367 - DNA, 15 bp, Homo sapiens
tgtatgaaatgatga

SEQ ID NO: 489368 - DNA, 15 bp, Homo sapiens
gtatgaaatgatgaa

SEQ ID NO: 489369 - DNA, 15 bp, Homo sapiens
atgaaatgatgaaaa

SEQ ID NO: 489370 - DNA, 15 bp, Homo sapiens
tgaaatgatgaaaag

SEQ ID NO: 489371 - DNA, 15 bp, Homo sapiens
gaaatgatgaaaagt

SEQ ID NO: 489372 - DNA, 15 bp, Homo sapiens
aaatgatgaaaagtg

SEQ ID NO: 489373 - DNA, 15 bp, Homo sapiens
aatgatgaaaagtgt

SEQ ID NO: 489374 - DNA, 15 bp, Homo sapiens
atgatgaaaagtgta

SEQ ID NO: 489375 - DNA, 15 bp, Homo sapiens
tgatgaaaagtgtat

SEQ ID NO: 489376 - DNA, 15 bp, Homo sapiens
gatgaaaagtgtatt

SEQ ID NO: 489377 - DNA, 15 bp, Homo sapiens
atgaaaagtgtattt

SEQ ID NO: 489378 - DNA, 15 bp, Homo sapiens
tgaaaagtgtatttt

SEQ ID NO: 489379 - DNA, 15 bp, Homo sapiens
gaaaagtgtatttta

SEQ ID NO: 489380 - DNA, 15 bp, Homo sapiens
aaaagtgtattttag

SEQ ID NO: 489381 - DNA, 15 bp, Homo sapiens
aaagtgtattttaga

SEQ ID NO: 489382 - DNA, 15 bp, Homo sapiens
aagtgtattttagaa

SEQ ID NO: 489383 - DNA, 15 bp, Homo sapiens
agtgtattttagaat

SEQ ID NO: 489384 - DNA, 15 bp, Homo sapiens
gtgtattttagaatc

SEQ ID NO: 489385 - DNA, 15 bp, Homo sapiens
tgtattttagaatcc

SEQ ID NO: 489386 - DNA, 15 bp, Homo sapiens
gtattttagaatcct

SEQ ID NO: 489387 - DNA, 15 bp, Homo sapiens
tattttagaatcctt

SEQ ID NO: 489388 - DNA, 15 bp, Homo sapiens
attttagaatccttt

SEQ ID NO: 489389 - DNA, 15 bp, Homo sapiens
ttttagaatcctttg

SEQ ID NO: 489390 - DNA, 15 bp, Homo sapiens
tttagaatcctttga

SEQ ID NO: 489391 - DNA, 15 bp, Homo sapiens
ttagaatcctttgaa

SEQ ID NO: 489392 - DNA, 15 bp, Homo sapiens
tagaatcctttgaaa

SEQ ID NO: 489393 - DNA, 15 bp, Homo sapiens
agaatcctttgaaat

SEQ ID NO: 489394 - DNA, 15 bp, Homo sapiens
gaatcctttgaaatc

SEQ ID NO: 489395 - DNA, 15 bp, Homo sapiens
aatcctttgaaatct

SEQ ID NO: 489396 - DNA, 15 bp, Homo sapiens
atcctttgaaatctc

SEQ ID NO: 489397 - DNA, 15 bp, Homo sapiens
tcctttgaaatctcc

SEQ ID NO: 489398 - DNA, 15 bp, Homo sapiens
cctttgaaatctcca

SEQ ID NO: 489399 - DNA, 15 bp, Homo sapiens
ctttgaaatctccat

SEQ ID NO: 489400 - DNA, 15 bp, Homo sapiens
tttgaaatctccatg

SEQ ID NO: 489401 - DNA, 15 bp, Homo sapiens
ttgaaatctccatgt

SEQ ID NO: 489402 - DNA, 15 bp, Homo sapiens
tgaaatctccatgtt

SEQ ID NO: 489403 - DNA, 15 bp, Homo sapiens
gaaatctccatgttt

SEQ ID NO: 489404 - DNA, 15 bp, Homo sapiens
aaatctccatgtttt

SEQ ID NO: 489405 - DNA, 15 bp, Homo sapiens
aatctccatgtttta

SEQ ID NO: 489406 - DNA, 15 bp, Homo sapiens
atctccatgttttaa

SEQ ID NO: 489407 - DNA, 15 bp, Homo sapiens
tctccatgttttaat

SEQ ID NO: 489408 - DNA, 15 bp, Homo sapiens
ctccatgttttaatt

SEQ ID NO: 489409 - DNA, 15 bp, Homo sapiens
tccatgttttaattt

SEQ ID NO: 489410 - DNA, 15 bp, Homo sapiens
ccatgttttaatttt

SEQ ID NO: 489411 - DNA, 15 bp, Homo sapiens
catgttttaattttt

SEQ ID NO: 489412 - DNA, 15 bp, Homo sapiens
atgttttaatttttg

SEQ ID NO: 489413 - DNA, 15 bp, Homo sapiens
tgttttaatttttgg

SEQ ID NO: 489414 - DNA, 15 bp, Homo sapiens
gttttaatttttggc

SEQ ID NO: 489415 - DNA, 15 bp, Homo sapiens
ttttaatttttggct

SEQ ID NO: 489416 - DNA, 15 bp, Homo sapiens
tttaatttttggctt

SEQ ID NO: 489417 - DNA, 15 bp, Homo sapiens
ttaatttttggcttc

SEQ ID NO: 489418 - DNA, 15 bp, Homo sapiens
taatttttggcttct

SEQ ID NO: 489419 - DNA, 15 bp, Homo sapiens
aatttttggcttctg

SEQ ID NO: 489420 - DNA, 15 bp, Homo sapiens
atttttggcttctga

SEQ ID NO: 489421 - DNA, 15 bp, Homo sapiens
tttttggcttctgaa

SEQ ID NO: 489422 - DNA, 15 bp, Homo sapiens
ttttggcttctgaaa

SEQ ID NO: 489423 - DNA, 15 bp, Homo sapiens
tttggcttctgaaag

SEQ ID NO: 489424 - DNA, 15 bp, Homo sapiens
ttggcttctgaaagt

SEQ ID NO: 489425 - DNA, 15 bp, Homo sapiens
tggcttctgaaagtt

SEQ ID NO: 489426 - DNA, 15 bp, Homo sapiens
ggcttctgaaagttc

SEQ ID NO: 489427 - DNA, 15 bp, Homo sapiens
gcttctgaaagttct

SEQ ID NO: 489428 - DNA, 15 bp, Homo sapiens
cttctgaaagttctg

SEQ ID NO: 489429 - DNA, 15 bp, Homo sapiens
ttctgaaagttctgc

SEQ ID NO: 489430 - DNA, 15 bp, Homo sapiens
tctgaaagttctgct

SEQ ID NO: 489431 - DNA, 15 bp, Homo sapiens
ctgaaagttctgcta

SEQ ID NO: 489432 - DNA, 15 bp, Homo sapiens
tgaaagttctgctat

SEQ ID NO: 489433 - DNA, 15 bp, Homo sapiens
gaaagttctgctatt

SEQ ID NO: 489434 - DNA, 15 bp, Homo sapiens
aaagttctgctattc

SEQ ID NO: 489435 - DNA, 15 bp, Homo sapiens
aagttctgctattca

SEQ ID NO: 489436 - DNA, 15 bp, Homo sapiens
agttctgctattcat

SEQ ID NO: 489437 - DNA, 15 bp, Homo sapiens
gttctgctattcata

SEQ ID NO: 489438 - DNA, 15 bp, Homo sapiens
ttctgctattcatat

SEQ ID NO: 489439 - DNA, 15 bp, Homo sapiens
tctgctattcatatt

SEQ ID NO: 489440 - DNA, 15 bp, Homo sapiens
ctgctattcatattt

SEQ ID NO: 489441 - DNA, 15 bp, Homo sapiens
tgctattcatatttt

SEQ ID NO: 489442 - DNA, 15 bp, Homo sapiens
gctattcatattttt

SEQ ID NO: 489443 - DNA, 15 bp, Homo sapiens
ctattcatatttttt

SEQ ID NO: 489444 - DNA, 15 bp, Homo sapiens
tattcatattttttc

SEQ ID NO: 489445 - DNA, 15 bp, Homo sapiens
attcatattttttct

SEQ ID NO: 489446 - DNA, 15 bp, Homo sapiens
ttcatattttttctc

SEQ ID NO: 489447 - DNA, 15 bp, Homo sapiens
tcatattttttctct

SEQ ID NO: 489448 - DNA, 15 bp, Homo sapiens
catattttttctctg

SEQ ID NO: 489449 - DNA, 15 bp, Homo sapiens
atattttttctctgg

SEQ ID NO: 489450 - DNA, 15 bp, Homo sapiens
tattttttctctggt

SEQ ID NO: 489451 - DNA, 15 bp, Homo sapiens
attttttctctggta

SEQ ID NO: 489452 - DNA, 15 bp, Homo sapiens
ttttttctctggtat

SEQ ID NO: 489453 - DNA, 15 bp, Homo sapiens
tttttctctggtatt

SEQ ID NO: 489454 - DNA, 15 bp, Homo sapiens
ttttctctggtatta

SEQ ID NO: 489455 - DNA, 15 bp, Homo sapiens
tttctctggtattat

SEQ ID NO: 489456 - DNA, 15 bp, Homo sapiens
ttctctggtattata

SEQ ID NO: 489457 - DNA, 15 bp, Homo sapiens
tctctggtattatat

SEQ ID NO: 489458 - DNA, 15 bp, Homo sapiens
ctctggtattatata

SEQ ID NO: 489459 - DNA, 15 bp, Homo sapiens
tctggtattatatac

SEQ ID NO: 489460 - DNA, 15 bp, Homo sapiens
ctggtattatataca

SEQ ID NO: 489461 - DNA, 15 bp, Homo sapiens
tggtattatatacaa

SEQ ID NO: 489462 - DNA, 15 bp, Homo sapiens
ggtattatatacaag

SEQ ID NO: 489463 - DNA, 15 bp, Homo sapiens
gtattatatacaaga

SEQ ID NO: 489464 - DNA, 15 bp, Homo sapiens
tattatatacaagac

SEQ ID NO: 489465 - DNA, 15 bp, Homo sapiens
attatatacaagaca

SEQ ID NO: 489466 - DNA, 15 bp, Homo sapiens
ttatatacaagacag

SEQ ID NO: 489467 - DNA, 15 bp, Homo sapiens
tatatacaagacagg

SEQ ID NO: 489468 - DNA, 15 bp, Homo sapiens
atatacaagacaggg

SEQ ID NO: 489469 - DNA, 15 bp, Homo sapiens
tatacaagacaggga

SEQ ID NO: 489470 - DNA, 15 bp, Homo sapiens
atacaagacagggac

SEQ ID NO: 489471 - DNA, 15 bp, Homo sapiens
tacaagacagggaca

SEQ ID NO: 489472 - DNA, 15 bp, Homo sapiens
acaagacagggacag

SEQ ID NO: 489473 - DNA, 15 bp, Homo sapiens
caagacagggacagc

SEQ ID NO: 489474 - DNA, 15 bp, Homo sapiens
aagacagggacagct

SEQ ID NO: 489475 - DNA, 15 bp, Homo sapiens
agacagggacagctt

SEQ ID NO: 489476 - DNA, 15 bp, Homo sapiens
gacagggacagcttt

SEQ ID NO: 489477 - DNA, 15 bp, Homo sapiens
acagggacagctttc

SEQ ID NO: 489478 - DNA, 15 bp, Homo sapiens
cagggacagctttcc

SEQ ID NO: 489479 - DNA, 15 bp, Homo sapiens
agggacagctttcca

SEQ ID NO: 489480 - DNA, 15 bp, Homo sapiens
gggacagctttccat

SEQ ID NO: 489481 - DNA, 15 bp, Homo sapiens
ggacagctttccata

SEQ ID NO: 489482 - DNA, 15 bp, Homo sapiens
gacagctttccataa

SEQ ID NO: 489483 - DNA, 15 bp, Homo sapiens
acagctttccataaa

SEQ ID NO: 489484 - DNA, 15 bp, Homo sapiens
cagctttccataaaa

SEQ ID NO: 489485 - DNA, 15 bp, Homo sapiens
agctttccataaaaa

SEQ ID NO: 489486 - DNA, 15 bp, Homo sapiens
gctttccataaaaat

SEQ ID NO: 489487 - DNA, 15 bp, Homo sapiens
ctttccataaaaata

SEQ ID NO: 489488 - DNA, 15 bp, Homo sapiens
tttccataaaaataa

SEQ ID NO: 489489 - DNA, 15 bp, Homo sapiens
ttccataaaaataaa

SEQ ID NO: 489490 - DNA, 15 bp, Homo sapiens
tccataaaaataaaa

SEQ ID NO: 489491 - DNA, 15 bp, Homo sapiens
ccataaaaataaaag

SEQ ID NO: 489492 - DNA, 15 bp, Homo sapiens
cataaaaataaaagc

SEQ ID NO: 489493 - DNA, 15 bp, Homo sapiens
ataaaaataaaagct

SEQ ID NO: 489494 - DNA, 15 bp, Homo sapiens
taaaaataaaagctg

SEQ ID NO: 489495 - DNA, 15 bp, Homo sapiens
aaaaataaaagctgt

SEQ ID NO: 489496 - DNA, 15 bp, Homo sapiens
aaaataaaagctgta

SEQ ID NO: 489497 - DNA, 15 bp, Homo sapiens
aaataaaagctgtat

SEQ ID NO: 489498 - DNA, 15 bp, Homo sapiens
aataaaagctgtatt

SEQ ID NO: 489499 - DNA, 15 bp, Homo sapiens
ataaaagctgtattg

SEQ ID NO: 489500 - DNA, 15 bp, Homo sapiens
taaaagctgtattga

SEQ ID NO: 489501 - DNA, 15 bp, Homo sapiens
aaaagctgtattgac

SEQ ID NO: 489502 - DNA, 15 bp, Homo sapiens
aaagctgtattgact

SEQ ID NO: 489503 - DNA, 15 bp, Homo sapiens
aagctgtattgactt

SEQ ID NO: 489504 - DNA, 15 bp, Homo sapiens
agctgtattgactta

SEQ ID NO: 489505 - DNA, 15 bp, Homo sapiens
gctgtattgacttat

SEQ ID NO: 489506 - DNA, 15 bp, Homo sapiens
ctgtattgacttatt

SEQ ID NO: 489507 - DNA, 15 bp, Homo sapiens
tgtattgacttattt

SEQ ID NO: 489508 - DNA, 15 bp, Homo sapiens
gtattgacttattta

SEQ ID NO: 489509 - DNA, 15 bp, Homo sapiens
tattgacttatttat

SEQ ID NO: 489510 - DNA, 15 bp, Homo sapiens
attgacttatttata

SEQ ID NO: 489511 - DNA, 15 bp, Homo sapiens
ttgacttatttataa

SEQ ID NO: 489512 - DNA, 15 bp, Homo sapiens
tgacttatttataaa

SEQ ID NO: 489513 - DNA, 15 bp, Homo sapiens
gacttatttataaaa

SEQ ID NO: 489514 - DNA, 15 bp, Homo sapiens
acttatttataaaat

SEQ ID NO: 489515 - DNA, 15 bp, Homo sapiens
cttatttataaaatt

SEQ ID NO: 489516 - DNA, 15 bp, Homo sapiens
ttatttataaaattg

SEQ ID NO: 489517 - DNA, 15 bp, Homo sapiens
tatttataaaattga

SEQ ID NO: 489518 - DNA, 15 bp, Homo sapiens
atttataaaattgat

SEQ ID NO: 489519 - DNA, 15 bp, Homo sapiens
tttataaaattgata

SEQ ID NO: 489520 - DNA, 15 bp, Homo sapiens
ttataaaattgatac

SEQ ID NO: 489521 - DNA, 15 bp, Homo sapiens
tataaaattgataca

SEQ ID NO: 489522 - DNA, 15 bp, Homo sapiens
ataaaattgatacat

SEQ ID NO: 489523 - DNA, 15 bp, Homo sapiens
taaaattgatacata

SEQ ID NO: 489524 - DNA, 15 bp, Homo sapiens
aaaattgatacatat

SEQ ID NO: 489525 - DNA, 15 bp, Homo sapiens
aaattgatacatatt

SEQ ID NO: 489526 - DNA, 15 bp, Homo sapiens
aattgatacatattt

SEQ ID NO: 489527 - DNA, 15 bp, Homo sapiens
attgatacatatttt

SEQ ID NO: 489528 - DNA, 15 bp, Homo sapiens
ttgatacatattttc

SEQ ID NO: 489529 - DNA, 15 bp, Homo sapiens
tgatacatattttca

SEQ ID NO: 489530 - DNA, 15 bp, Homo sapiens
gatacatattttcat

SEQ ID NO: 489531 - DNA, 15 bp, Homo sapiens
atacatattttcata

SEQ ID NO: 489532 - DNA, 15 bp, Homo sapiens
tacatattttcatat

SEQ ID NO: 489533 - DNA, 15 bp, Homo sapiens
acatattttcatatt

SEQ ID NO: 489534 - DNA, 15 bp, Homo sapiens
catattttcatattc

SEQ ID NO: 489535 - DNA, 15 bp, Homo sapiens
atattttcatattct

SEQ ID NO: 489536 - DNA, 15 bp, Homo sapiens
tattttcatattctg

SEQ ID NO: 489537 - DNA, 15 bp, Homo sapiens
attttcatattctgc

SEQ ID NO: 489538 - DNA, 15 bp, Homo sapiens
ttttcatattctgcc

SEQ ID NO: 489539 - DNA, 15 bp, Homo sapiens
tttcatattctgcct

SEQ ID NO: 489540 - DNA, 15 bp, Homo sapiens
ttcatattctgcctg

SEQ ID NO: 489541 - DNA, 15 bp, Homo sapiens
tcatattctgcctgt

SEQ ID NO: 489542 - DNA, 15 bp, Homo sapiens
catattctgcctgta

SEQ ID NO: 489543 - DNA, 15 bp, Homo sapiens
atattctgcctgtaa

SEQ ID NO: 489544 - DNA, 15 bp, Homo sapiens
tattctgcctgtaat

SEQ ID NO: 489545 - DNA, 15 bp, Homo sapiens
attctgcctgtaatt

SEQ ID NO: 489546 - DNA, 15 bp, Homo sapiens
ttctgcctgtaatta

SEQ ID NO: 489547 - DNA, 15 bp, Homo sapiens
tctgcctgtaattat

SEQ ID NO: 489548 - DNA, 15 bp, Homo sapiens
ctgcctgtaattatt

SEQ ID NO: 489549 - DNA, 15 bp, Homo sapiens
tgcctgtaattatta

SEQ ID NO: 489550 - DNA, 15 bp, Homo sapiens
gcctgtaattattaa

SEQ ID NO: 489551 - DNA, 15 bp, Homo sapiens
cctgtaattattaaa

SEQ ID NO: 489552 - DNA, 15 bp, Homo sapiens
ctgtaattattaaac

SEQ ID NO: 489553 - DNA, 15 bp, Homo sapiens
tgtaattattaaacc

SEQ ID NO: 489554 - DNA, 15 bp, Homo sapiens
gtaattattaaacct

SEQ ID NO: 489555 - DNA, 15 bp, Homo sapiens
taattattaaacctt

SEQ ID NO: 489556 - DNA, 15 bp, Homo sapiens
aattattaaaccttt

SEQ ID NO: 489557 - DNA, 15 bp, Homo sapiens
attattaaacctttt

SEQ ID NO: 489558 - DNA, 15 bp, Homo sapiens
ttattaaacctttta

SEQ ID NO: 489559 - DNA, 15 bp, Homo sapiens
tattaaaccttttaa

SEQ ID NO: 489560 - DNA, 15 bp, Homo sapiens
attaaaccttttaaa

SEQ ID NO: 489561 - DNA, 15 bp, Homo sapiens
ttaaaccttttaaaa

SEQ ID NO: 489562 - DNA, 15 bp, Homo sapiens
taaaccttttaaaaa

SEQ ID NO: 489563 - DNA, 15 bp, Homo sapiens
aaaccttttaaaaat

SEQ ID NO: 489564 - DNA, 15 bp, Homo sapiens
aaccttttaaaaatt

SEQ ID NO: 489565 - DNA, 15 bp, Homo sapiens
accttttaaaaattg

SEQ ID NO: 489566 - DNA, 15 bp, Homo sapiens
ccttttaaaaattga

SEQ ID NO: 489567 - DNA, 15 bp, Homo sapiens
cttttaaaaattgat

SEQ ID NO: 489568 - DNA, 15 bp, Homo sapiens
ttttaaaaattgatg

SEQ ID NO: 489569 - DNA, 15 bp, Homo sapiens
tttaaaaattgatgc

SEQ ID NO: 489570 - DNA, 15 bp, Homo sapiens
ttaaaaattgatgca

SEQ ID NO: 489571 - DNA, 15 bp, Homo sapiens
taaaaattgatgcaa

SEQ ID NO: 489572 - DNA, 15 bp, Homo sapiens
aaaaattgatgcaaa

SEQ ID NO: 489573 - DNA, 15 bp, Homo sapiens
aaaattgatgcaaaa

SEQ ID NO: 489574 - DNA, 15 bp, Homo sapiens
aaattgatgcaaaat

SEQ ID NO: 489575 - DNA, 15 bp, Homo sapiens
aattgatgcaaaata

SEQ ID NO: 489576 - DNA, 15 bp, Homo sapiens
attgatgcaaaatag

SEQ ID NO: 489577 - DNA, 15 bp, Homo sapiens
ttgatgcaaaataga

SEQ ID NO: 489578 - DNA, 15 bp, Homo sapiens
tgatgcaaaatagaa

SEQ ID NO: 489579 - DNA, 15 bp, Homo sapiens
gatgcaaaatagaaa

SEQ ID NO: 489580 - DNA, 15 bp, Homo sapiens
atgcaaaatagaaat

SEQ ID NO: 489581 - DNA, 15 bp, Homo sapiens
tgcaaaatagaaatc

SEQ ID NO: 489582 - DNA, 15 bp, Homo sapiens
gcaaaatagaaatca

SEQ ID NO: 489583 - DNA, 15 bp, Homo sapiens
caaaatagaaatcag

SEQ ID NO: 489584 - DNA, 15 bp, Homo sapiens
aaaatagaaatcagc

SEQ ID NO: 489585 - DNA, 15 bp, Homo sapiens
aaatagaaatcagcg

SEQ ID NO: 489586 - DNA, 15 bp, Homo sapiens
aatagaaatcagcgt

SEQ ID NO: 489587 - DNA, 15 bp, Homo sapiens
atagaaatcagcgtg

SEQ ID NO: 489588 - DNA, 15 bp, Homo sapiens
tagaaatcagcgtgg

SEQ ID NO: 489589 - DNA, 15 bp, Homo sapiens
agaaatcagcgtggg

SEQ ID NO: 489590 - DNA, 15 bp, Homo sapiens
gaaatcagcgtggga

SEQ ID NO: 489591 - DNA, 15 bp, Homo sapiens
aaatcagcgtgggag

SEQ ID NO: 489592 - DNA, 15 bp, Homo sapiens
aatcagcgtgggagg

SEQ ID NO: 489593 - DNA, 15 bp, Homo sapiens
atcagcgtgggaggt

SEQ ID NO: 489594 - DNA, 15 bp, Homo sapiens
tcagcgtgggaggta

SEQ ID NO: 489595 - DNA, 15 bp, Homo sapiens
cagcgtgggaggtag

SEQ ID NO: 489596 - DNA, 15 bp, Homo sapiens
agcgtgggaggtaga

SEQ ID NO: 489597 - DNA, 15 bp, Homo sapiens
gcgtgggaggtagac

SEQ ID NO: 489598 - DNA, 15 bp, Homo sapiens
cgtgggaggtagact

SEQ ID NO: 489599 - DNA, 15 bp, Homo sapiens
gtgggaggtagactc

SEQ ID NO: 489600 - DNA, 15 bp, Homo sapiens
tgggaggtagactca

SEQ ID NO: 489601 - DNA, 15 bp, Homo sapiens
gggaggtagactcag

SEQ ID NO: 489602 - DNA, 15 bp, Homo sapiens
ggaggtagactcagt

SEQ ID NO: 489603 - DNA, 15 bp, Homo sapiens
gaggtagactcagtg

SEQ ID NO: 489604 - DNA, 15 bp, Homo sapiens
aggtagactcagtgc

SEQ ID NO: 489605 - DNA, 15 bp, Homo sapiens
ggtagactcagtgcc

SEQ ID NO: 489606 - DNA, 15 bp, Homo sapiens
gtagactcagtgccc

SEQ ID NO: 489607 - DNA, 15 bp, Homo sapiens
tagactcagtgccca

SEQ ID NO: 489608 - DNA, 15 bp, Homo sapiens
agactcagtgcccag

SEQ ID NO: 489609 - DNA, 15 bp, Homo sapiens
gactcagtgcccagt

SEQ ID NO: 489610 - DNA, 15 bp, Homo sapiens
actcagtgcccagtg

SEQ ID NO: 489611 - DNA, 15 bp, Homo sapiens
ctcagtgcccagtgc

SEQ ID NO: 489612 - DNA, 15 bp, Homo sapiens
tcagtgcccagtgca

SEQ ID NO: 489613 - DNA, 15 bp, Homo sapiens
cagtgcccagtgcat

SEQ ID NO: 489614 - DNA, 15 bp, Homo sapiens
agtgcccagtgcatg

SEQ ID NO: 489615 - DNA, 15 bp, Homo sapiens
gtgcccagtgcatgt

SEQ ID NO: 489616 - DNA, 15 bp, Homo sapiens
tgcccagtgcatgtg

SEQ ID NO: 489617 - DNA, 15 bp, Homo sapiens
gcccagtgcatgtgt

SEQ ID NO: 489618 - DNA, 15 bp, Homo sapiens
cccagtgcatgtgtc

SEQ ID NO: 489619 - DNA, 15 bp, Homo sapiens
ccagtgcatgtgtct

SEQ ID NO: 489620 - DNA, 15 bp, Homo sapiens
cagtgcatgtgtctt

SEQ ID NO: 489621 - DNA, 15 bp, Homo sapiens
gtgcatgtgtctttc

SEQ ID NO: 489622 - DNA, 15 bp, Homo sapiens
tgcatgtgtctttct

SEQ ID NO: 489623 - DNA, 15 bp, Homo sapiens
gcatgtgtctttctc

SEQ ID NO: 489624 - DNA, 15 bp, Homo sapiens
catgtgtctttctct

SEQ ID NO: 489625 - DNA, 15 bp, Homo sapiens
atgtgtctttctctc

SEQ ID NO: 489626 - DNA, 15 bp, Homo sapiens
tgtgtctttctctct

SEQ ID NO: 489627 - DNA, 15 bp, Homo sapiens
gtgtctttctctctc

SEQ ID NO: 489628 - DNA, 15 bp, Homo sapiens
tgtctttctctctct

SEQ ID NO: 489629 - DNA, 15 bp, Homo sapiens
gtctttctctctctt

SEQ ID NO: 489630 - DNA, 15 bp, Homo sapiens
tctttctctctcttt

SEQ ID NO: 489631 - DNA, 15 bp, Homo sapiens
ctttctctctctttt

SEQ ID NO: 489632 - DNA, 15 bp, Homo sapiens
tttctctctcttttt

SEQ ID NO: 489633 - DNA, 15 bp, Homo sapiens
tttttttttctgaga

SEQ ID NO: 489634 - DNA, 15 bp, Homo sapiens
ttttttttctgagac

SEQ ID NO: 489635 - DNA, 15 bp, Homo sapiens
tttttttctgagaca

SEQ ID NO: 489636 - DNA, 15 bp, Homo sapiens
ttttttctgagacag

SEQ ID NO: 489637 - DNA, 15 bp, Homo sapiens
tttttctgagacaga

SEQ ID NO: 489638 - DNA, 15 bp, Homo sapiens
ttttctgagacagag

SEQ ID NO: 489639 - DNA, 15 bp, Homo sapiens
tttctgagacagaga

SEQ ID NO: 489640 - DNA, 15 bp, Homo sapiens
ttctgagacagagac

SEQ ID NO: 489641 - DNA, 15 bp, Homo sapiens
tctgagacagagact

SEQ ID NO: 489642 - DNA, 15 bp, Homo sapiens
ctgagacagagactc

SEQ ID NO: 489643 - DNA, 15 bp, Homo sapiens
tgagacagagactca

SEQ ID NO: 489644 - DNA, 15 bp, Homo sapiens
gagacagagactcac

SEQ ID NO: 489645 - DNA, 15 bp, Homo sapiens
agacagagactcact

SEQ ID NO: 489646 - DNA, 15 bp, Homo sapiens
gacagagactcactc

SEQ ID NO: 489647 - DNA, 15 bp, Homo sapiens
acagagactcactct

SEQ ID NO: 489648 - DNA, 15 bp, Homo sapiens
cagagactcactctg

SEQ ID NO: 489649 - DNA, 15 bp, Homo sapiens
agagactcactctgt

SEQ ID NO: 489650 - DNA, 15 bp, Homo sapiens
gagactcactctgtt

SEQ ID NO: 489651 - DNA, 15 bp, Homo sapiens
agactcactctgttg

SEQ ID NO: 489652 - DNA, 15 bp, Homo sapiens
gactcactctgttgc

SEQ ID NO: 489653 - DNA, 15 bp, Homo sapiens
actcactctgttgcc

SEQ ID NO: 489654 - DNA, 15 bp, Homo sapiens
caggctggagttcaa

SEQ ID NO: 489655 - DNA, 15 bp, Homo sapiens
aggctggagttcaat

SEQ ID NO: 489656 - DNA, 15 bp, Homo sapiens
ggctggagttcaatg

SEQ ID NO: 489657 - DNA, 15 bp, Homo sapiens
gctggagttcaatgg

SEQ ID NO: 489658 - DNA, 15 bp, Homo sapiens
ctggagttcaatggc

SEQ ID NO: 489659 - DNA, 15 bp, Homo sapiens
tggagttcaatggca

SEQ ID NO: 489660 - DNA, 15 bp, Homo sapiens
ggagttcaatggcac

SEQ ID NO: 489661 - DNA, 15 bp, Homo sapiens
gagttcaatggcacg

SEQ ID NO: 489662 - DNA, 15 bp, Homo sapiens
agttcaatggcacga

SEQ ID NO: 489663 - DNA, 15 bp, Homo sapiens
gttcaatggcacgat

SEQ ID NO: 489664 - DNA, 15 bp, Homo sapiens
ttcaatggcacgatc

SEQ ID NO: 489665 - DNA, 15 bp, Homo sapiens
tcaatggcacgatct

SEQ ID NO: 489666 - DNA, 15 bp, Homo sapiens
tggcacgatctcagg

SEQ ID NO: 489667 - DNA, 15 bp, Homo sapiens
ggcacgatctcaggt

SEQ ID NO: 489668 - DNA, 15 bp, Homo sapiens
gcacgatctcaggtc

SEQ ID NO: 489669 - DNA, 15 bp, Homo sapiens
cacgatctcaggtct

SEQ ID NO: 489670 - DNA, 15 bp, Homo sapiens
acgatctcaggtctg

SEQ ID NO: 489671 - DNA, 15 bp, Homo sapiens
cgatctcaggtctgt

SEQ ID NO: 489672 - DNA, 15 bp, Homo sapiens
gatctcaggtctgta

SEQ ID NO: 489673 - DNA, 15 bp, Homo sapiens
atctcaggtctgtat

SEQ ID NO: 489674 - DNA, 15 bp, Homo sapiens
tctcaggtctgtata

SEQ ID NO: 489675 - DNA, 15 bp, Homo sapiens
ctcaggtctgtataa

SEQ ID NO: 489676 - DNA, 15 bp, Homo sapiens
tcaggtctgtataac

SEQ ID NO: 489677 - DNA, 15 bp, Homo sapiens
caggtctgtataacc

SEQ ID NO: 489678 - DNA, 15 bp, Homo sapiens
aggtctgtataacct

SEQ ID NO: 489679 - DNA, 15 bp, Homo sapiens
ggtctgtataacctc

SEQ ID NO: 489680 - DNA, 15 bp, Homo sapiens
gtctgtataacctcc

SEQ ID NO: 489681 - DNA, 15 bp, Homo sapiens
tctgtataacctcca

SEQ ID NO: 489682 - DNA, 15 bp, Homo sapiens
ctgtataacctccac

SEQ ID NO: 489683 - DNA, 15 bp, Homo sapiens
tgtataacctccacc

SEQ ID NO: 489684 - DNA, 15 bp, Homo sapiens
gtataacctccacct

SEQ ID NO: 489685 - DNA, 15 bp, Homo sapiens
tataacctccacctc

SEQ ID NO: 489686 - DNA, 15 bp, Homo sapiens
ataacctccacctcc

SEQ ID NO: 489687 - DNA, 15 bp, Homo sapiens
taacctccacctccc

SEQ ID NO: 489688 - DNA, 15 bp, Homo sapiens
ctccacctcccaggc

SEQ ID NO: 489689 - DNA, 15 bp, Homo sapiens
cacctcccaggctca

SEQ ID NO: 489690 - DNA, 15 bp, Homo sapiens
cccaggctcaagcaa

SEQ ID NO: 489691 - DNA, 15 bp, Homo sapiens
ccaggctcaagcaat

SEQ ID NO: 489692 - DNA, 15 bp, Homo sapiens
caggctcaagcaatt

SEQ ID NO: 489693 - DNA, 15 bp, Homo sapiens
aggctcaagcaattc

SEQ ID NO: 489694 - DNA, 15 bp, Homo sapiens
ctcaagcaattctca

SEQ ID NO: 489695 - DNA, 15 bp, Homo sapiens
ggcacatgccaccac

SEQ ID NO: 489696 - DNA, 15 bp, Homo sapiens
gcacatgccaccacg

SEQ ID NO: 489697 - DNA, 15 bp, Homo sapiens
cacatgccaccacgc

SEQ ID NO: 489698 - DNA, 15 bp, Homo sapiens
acatgccaccacgcc

SEQ ID NO: 489699 - DNA, 15 bp, Homo sapiens
catgccaccacgccc

SEQ ID NO: 489700 - DNA, 15 bp, Homo sapiens
atgccaccacgccca

SEQ ID NO: 489701 - DNA, 15 bp, Homo sapiens
tgccaccacgcccaa

SEQ ID NO: 489702 - DNA, 15 bp, Homo sapiens
gccaccacgcccaac

SEQ ID NO: 489703 - DNA, 15 bp, Homo sapiens
ccaccacgcccaact

SEQ ID NO: 489704 - DNA, 15 bp, Homo sapiens
caccacgcccaacta

SEQ ID NO: 489705 - DNA, 15 bp, Homo sapiens
accacgcccaactaa

SEQ ID NO: 489706 - DNA, 15 bp, Homo sapiens
ccacgcccaactaat

SEQ ID NO: 489707 - DNA, 15 bp, Homo sapiens
cacgcccaactaatt

SEQ ID NO: 489708 - DNA, 15 bp, Homo sapiens
acgcccaactaattt

SEQ ID NO: 489709 - DNA, 15 bp, Homo sapiens
cgcccaactaatttt

SEQ ID NO: 489710 - DNA, 15 bp, Homo sapiens
tttttagtagagatc

SEQ ID NO: 489711 - DNA, 15 bp, Homo sapiens
ttttagtagagatcg

SEQ ID NO: 489712 - DNA, 15 bp, Homo sapiens
tttagtagagatcgg

SEQ ID NO: 489713 - DNA, 15 bp, Homo sapiens
ttagtagagatcggg

SEQ ID NO: 489714 - DNA, 15 bp, Homo sapiens
tagtagagatcgggt

SEQ ID NO: 489715 - DNA, 15 bp, Homo sapiens
agtagagatcgggtt

SEQ ID NO: 489716 - DNA, 15 bp, Homo sapiens
gtagagatcgggttt

SEQ ID NO: 489717 - DNA, 15 bp, Homo sapiens
tagagatcgggtttc

SEQ ID NO: 489718 - DNA, 15 bp, Homo sapiens
agagatcgggtttca

SEQ ID NO: 489719 - DNA, 15 bp, Homo sapiens
gagatcgggtttcac

SEQ ID NO: 489720 - DNA, 15 bp, Homo sapiens
agatcgggtttcacc

SEQ ID NO: 489721 - DNA, 15 bp, Homo sapiens
gatcgggtttcacca

SEQ ID NO: 489722 - DNA, 15 bp, Homo sapiens
atcgggtttcaccat

SEQ ID NO: 489723 - DNA, 15 bp, Homo sapiens
tcgggtttcaccatg

SEQ ID NO: 489724 - DNA, 15 bp, Homo sapiens
cgggtttcaccatgt

SEQ ID NO: 489725 - DNA, 15 bp, Homo sapiens
ctggcctcaagtgac

SEQ ID NO: 489726 - DNA, 15 bp, Homo sapiens
tggcctcaagtgacc

SEQ ID NO: 489727 - DNA, 15 bp, Homo sapiens
ggcctcaagtgaccc

SEQ ID NO: 489728 - DNA, 15 bp, Homo sapiens
gcctcaagtgaccca

SEQ ID NO: 489729 - DNA, 15 bp, Homo sapiens
cctcaagtgacccac

SEQ ID NO: 489730 - DNA, 15 bp, Homo sapiens
ctcaagtgacccacc

SEQ ID NO: 489731 - DNA, 15 bp, Homo sapiens
tcaagtgacccaccc

SEQ ID NO: 489732 - DNA, 15 bp, Homo sapiens
caagtgacccaccca

SEQ ID NO: 489733 - DNA, 15 bp, Homo sapiens
aagtgacccacccac

SEQ ID NO: 489734 - DNA, 15 bp, Homo sapiens
agtgacccacccacc

SEQ ID NO: 489735 - DNA, 15 bp, Homo sapiens
gtgacccacccaccc

SEQ ID NO: 489736 - DNA, 15 bp, Homo sapiens
tgacccacccaccct

SEQ ID NO: 489737 - DNA, 15 bp, Homo sapiens
gacccacccaccctg

SEQ ID NO: 489738 - DNA, 15 bp, Homo sapiens
acccacccaccctgg

SEQ ID NO: 489739 - DNA, 15 bp, Homo sapiens
cccacccaccctggc

SEQ ID NO: 489740 - DNA, 15 bp, Homo sapiens
ccacccaccctggcc

SEQ ID NO: 489741 - DNA, 15 bp, Homo sapiens
cacccaccctggcct

SEQ ID NO: 489742 - DNA, 15 bp, Homo sapiens
acccaccctggcctc

SEQ ID NO: 489743 - DNA, 15 bp, Homo sapiens
cccaccctggcctcc

SEQ ID NO: 489744 - DNA, 15 bp, Homo sapiens
ccaccctggcctccc

SEQ ID NO: 489745 - DNA, 15 bp, Homo sapiens
caccctggcctccca

SEQ ID NO: 489746 - DNA, 15 bp, Homo sapiens
accctggcctcccaa

SEQ ID NO: 489747 - DNA, 15 bp, Homo sapiens
ccctggcctcccaaa

SEQ ID NO: 489748 - DNA, 15 bp, Homo sapiens
cctggcctcccaaac

SEQ ID NO: 489749 - DNA, 15 bp, Homo sapiens
ctggcctcccaaacc

SEQ ID NO: 489750 - DNA, 15 bp, Homo sapiens
tggcctcccaaaccg

SEQ ID NO: 489751 - DNA, 15 bp, Homo sapiens
ggcctcccaaaccgc

SEQ ID NO: 489752 - DNA, 15 bp, Homo sapiens
gcctcccaaaccgct

SEQ ID NO: 489753 - DNA, 15 bp, Homo sapiens
cctcccaaaccgctg

SEQ ID NO: 489754 - DNA, 15 bp, Homo sapiens
ctcccaaaccgctgg

SEQ ID NO: 489755 - DNA, 15 bp, Homo sapiens
tcccaaaccgctggg

SEQ ID NO: 489756 - DNA, 15 bp, Homo sapiens
cccaaaccgctggga

SEQ ID NO: 489757 - DNA, 15 bp, Homo sapiens
ccaaaccgctgggat

SEQ ID NO: 489758 - DNA, 15 bp, Homo sapiens
caaaccgctgggatt

SEQ ID NO: 489759 - DNA, 15 bp, Homo sapiens
aaaccgctgggatta

SEQ ID NO: 489760 - DNA, 15 bp, Homo sapiens
aaccgctgggattac

SEQ ID NO: 489761 - DNA, 15 bp, Homo sapiens
accgctgggattaca

SEQ ID NO: 489762 - DNA, 15 bp, Homo sapiens
ccgctgggattacac

SEQ ID NO: 489763 - DNA, 15 bp, Homo sapiens
cgctgggattacacg

SEQ ID NO: 489764 - DNA, 15 bp, Homo sapiens
gctgggattacacgc

SEQ ID NO: 489765 - DNA, 15 bp, Homo sapiens
ctgggattacacgcg

SEQ ID NO: 489766 - DNA, 15 bp, Homo sapiens
tgggattacacgcgt

SEQ ID NO: 489767 - DNA, 15 bp, Homo sapiens
gggattacacgcgtg

SEQ ID NO: 489768 - DNA, 15 bp, Homo sapiens
ggattacacgcgtga

SEQ ID NO: 489769 - DNA, 15 bp, Homo sapiens
gattacacgcgtgag

SEQ ID NO: 489770 - DNA, 15 bp, Homo sapiens
attacacgcgtgagc

SEQ ID NO: 489771 - DNA, 15 bp, Homo sapiens
ttacacgcgtgagcc

SEQ ID NO: 489772 - DNA, 15 bp, Homo sapiens
tacacgcgtgagcca

SEQ ID NO: 489773 - DNA, 15 bp, Homo sapiens
acacgcgtgagccac

SEQ ID NO: 489774 - DNA, 15 bp, Homo sapiens
cacgcgtgagccacc

SEQ ID NO: 489775 - DNA, 15 bp, Homo sapiens
acgcgtgagccacca

SEQ ID NO: 489776 - DNA, 15 bp, Homo sapiens
cgcgtgagccaccac

SEQ ID NO: 489777 - DNA, 15 bp, Homo sapiens
caccacacccggccc

SEQ ID NO: 489778 - DNA, 15 bp, Homo sapiens
accacacccggcccc

SEQ ID NO: 489779 - DNA, 15 bp, Homo sapiens
ccacacccggcccca

SEQ ID NO: 489780 - DNA, 15 bp, Homo sapiens
cacacccggccccaa

SEQ ID NO: 489781 - DNA, 15 bp, Homo sapiens
acacccggccccaat

SEQ ID NO: 489782 - DNA, 15 bp, Homo sapiens
cacccggccccaata

SEQ ID NO: 489783 - DNA, 15 bp, Homo sapiens
acccggccccaatac

SEQ ID NO: 489784 - DNA, 15 bp, Homo sapiens
cccggccccaataca

SEQ ID NO: 489785 - DNA, 15 bp, Homo sapiens
ccggccccaatacat

SEQ ID NO: 489786 - DNA, 15 bp, Homo sapiens
cggccccaatacatg

SEQ ID NO: 489787 - DNA, 15 bp, Homo sapiens
ggccccaatacatgt

SEQ ID NO: 489788 - DNA, 15 bp, Homo sapiens
gccccaatacatgtt

SEQ ID NO: 489789 - DNA, 15 bp, Homo sapiens
ccccaatacatgttt

SEQ ID NO: 489790 - DNA, 15 bp, Homo sapiens
cccaatacatgtttc

SEQ ID NO: 489791 - DNA, 15 bp, Homo sapiens
ccaatacatgtttct

SEQ ID NO: 489792 - DNA, 15 bp, Homo sapiens
caatacatgtttctg

SEQ ID NO: 489793 - DNA, 15 bp, Homo sapiens
aatacatgtttctga

SEQ ID NO: 489794 - DNA, 15 bp, Homo sapiens
atacatgtttctgac

SEQ ID NO: 489795 - DNA, 15 bp, Homo sapiens
tacatgtttctgact

SEQ ID NO: 489796 - DNA, 15 bp, Homo sapiens
acatgtttctgactt

SEQ ID NO: 489797 - DNA, 15 bp, Homo sapiens
catgtttctgacttg

SEQ ID NO: 489798 - DNA, 15 bp, Homo sapiens
atgtttctgacttga

SEQ ID NO: 489799 - DNA, 15 bp, Homo sapiens
tgtttctgacttgag

SEQ ID NO: 489800 - DNA, 15 bp, Homo sapiens
gtttctgacttgagt

SEQ ID NO: 489801 - DNA, 15 bp, Homo sapiens
tttctgacttgagtg

SEQ ID NO: 489802 - DNA, 15 bp, Homo sapiens
ttctgacttgagtga

SEQ ID NO: 489803 - DNA, 15 bp, Homo sapiens
tctgacttgagtgaa

SEQ ID NO: 489804 - DNA, 15 bp, Homo sapiens
ctgacttgagtgaat

SEQ ID NO: 489805 - DNA, 15 bp, Homo sapiens
tgacttgagtgaatg

SEQ ID NO: 489806 - DNA, 15 bp, Homo sapiens
gacttgagtgaatga

SEQ ID NO: 489807 - DNA, 15 bp, Homo sapiens
acttgagtgaatgat

SEQ ID NO: 489808 - DNA, 15 bp, Homo sapiens
cttgagtgaatgatt

SEQ ID NO: 489809 - DNA, 15 bp, Homo sapiens
ttgagtgaatgatta

SEQ ID NO: 489810 - DNA, 15 bp, Homo sapiens
tgagtgaatgattac

SEQ ID NO: 489811 - DNA, 15 bp, Homo sapiens
gagtgaatgattaca

SEQ ID NO: 489812 - DNA, 15 bp, Homo sapiens
agtgaatgattacat

SEQ ID NO: 489813 - DNA, 15 bp, Homo sapiens
gtgaatgattacatt

SEQ ID NO: 489814 - DNA, 15 bp, Homo sapiens
tgaatgattacattt

SEQ ID NO: 489815 - DNA, 15 bp, Homo sapiens
gaatgattacatttt

SEQ ID NO: 489816 - DNA, 15 bp, Homo sapiens
aatgattacattttc

SEQ ID NO: 489817 - DNA, 15 bp, Homo sapiens
atgattacattttct

SEQ ID NO: 489818 - DNA, 15 bp, Homo sapiens
tgattacattttcta

SEQ ID NO: 489819 - DNA, 15 bp, Homo sapiens
gattacattttctag

SEQ ID NO: 489820 - DNA, 15 bp, Homo sapiens
attacattttctagc

SEQ ID NO: 489821 - DNA, 15 bp, Homo sapiens
ttacattttctagct

SEQ ID NO: 489822 - DNA, 15 bp, Homo sapiens
tacattttctagctg

SEQ ID NO: 489823 - DNA, 15 bp, Homo sapiens
acattttctagctgg

SEQ ID NO: 489824 - DNA, 15 bp, Homo sapiens
cattttctagctggg

SEQ ID NO: 489825 - DNA, 15 bp, Homo sapiens
attttctagctggga

SEQ ID NO: 489826 - DNA, 15 bp, Homo sapiens
ttttctagctgggaa

SEQ ID NO: 489827 - DNA, 15 bp, Homo sapiens
tttctagctgggaag

SEQ ID NO: 489828 - DNA, 15 bp, Homo sapiens
ttctagctgggaagg

SEQ ID NO: 489829 - DNA, 15 bp, Homo sapiens
tctagctgggaaggt

SEQ ID NO: 489830 - DNA, 15 bp, Homo sapiens
ctagctgggaaggtt

SEQ ID NO: 489831 - DNA, 15 bp, Homo sapiens
tagctgggaaggttt

SEQ ID NO: 489832 - DNA, 15 bp, Homo sapiens
agctgggaaggtttc

SEQ ID NO: 489833 - DNA, 15 bp, Homo sapiens
gctgggaaggtttcc

SEQ ID NO: 489834 - DNA, 15 bp, Homo sapiens
ctgggaaggtttcct

SEQ ID NO: 489835 - DNA, 15 bp, Homo sapiens
tgggaaggtttcctt

SEQ ID NO: 489836 - DNA, 15 bp, Homo sapiens
gggaaggtttccttg

SEQ ID NO: 489837 - DNA, 15 bp, Homo sapiens
ggaaggtttccttgt

SEQ ID NO: 489838 - DNA, 15 bp, Homo sapiens
gaaggtttccttgta

SEQ ID NO: 489839 - DNA, 15 bp, Homo sapiens
aaggtttccttgtag

SEQ ID NO: 489840 - DNA, 15 bp, Homo sapiens
aggtttccttgtagc

SEQ ID NO: 489841 - DNA, 15 bp, Homo sapiens
ggtttccttgtagca

SEQ ID NO: 489842 - DNA, 15 bp, Homo sapiens
gtttccttgtagcat

SEQ ID NO: 489843 - DNA, 15 bp, Homo sapiens
tttccttgtagcatt

SEQ ID NO: 489844 - DNA, 15 bp, Homo sapiens
ttccttgtagcattc

SEQ ID NO: 489845 - DNA, 15 bp, Homo sapiens
tccttgtagcattcc

SEQ ID NO: 489846 - DNA, 15 bp, Homo sapiens
ccttgtagcattcct

SEQ ID NO: 489847 - DNA, 15 bp, Homo sapiens
cttgtagcattccta

SEQ ID NO: 489848 - DNA, 15 bp, Homo sapiens
ttgtagcattcctag

SEQ ID NO: 489849 - DNA, 15 bp, Homo sapiens
tgtagcattcctaga

SEQ ID NO: 489850 - DNA, 15 bp, Homo sapiens
gtagcattcctagat

SEQ ID NO: 489851 - DNA, 15 bp, Homo sapiens
tagcattcctagata

SEQ ID NO: 489852 - DNA, 15 bp, Homo sapiens
agcattcctagatag

SEQ ID NO: 489853 - DNA, 15 bp, Homo sapiens
gcattcctagatagt

SEQ ID NO: 489854 - DNA, 15 bp, Homo sapiens
cattcctagatagta

SEQ ID NO: 489855 - DNA, 15 bp, Homo sapiens
attcctagatagtac

SEQ ID NO: 489856 - DNA, 15 bp, Homo sapiens
ttcctagatagtact

SEQ ID NO: 489857 - DNA, 15 bp, Homo sapiens
tcctagatagtactc

SEQ ID NO: 489858 - DNA, 15 bp, Homo sapiens
cctagatagtactca

SEQ ID NO: 489859 - DNA, 15 bp, Homo sapiens
ctagatagtactcag

SEQ ID NO: 489860 - DNA, 15 bp, Homo sapiens
tagatagtactcaga

SEQ ID NO: 489861 - DNA, 15 bp, Homo sapiens
agatagtactcagaa

SEQ ID NO: 489862 - DNA, 15 bp, Homo sapiens
gatagtactcagaac

SEQ ID NO: 489863 - DNA, 15 bp, Homo sapiens
atagtactcagaacg

SEQ ID NO: 489864 - DNA, 15 bp, Homo sapiens
tagtactcagaacgt

SEQ ID NO: 489865 - DNA, 15 bp, Homo sapiens
agtactcagaacgtt

SEQ ID NO: 489866 - DNA, 15 bp, Homo sapiens
gtactcagaacgttt

SEQ ID NO: 489867 - DNA, 15 bp, Homo sapiens
tactcagaacgtttt

SEQ ID NO: 489868 - DNA, 15 bp, Homo sapiens
actcagaacgttttg

SEQ ID NO: 489869 - DNA, 15 bp, Homo sapiens
ctcagaacgttttgt

SEQ ID NO: 489870 - DNA, 15 bp, Homo sapiens
tcagaacgttttgta

SEQ ID NO: 489871 - DNA, 15 bp, Homo sapiens
cagaacgttttgtag

SEQ ID NO: 489872 - DNA, 15 bp, Homo sapiens
agaacgttttgtagg

SEQ ID NO: 489873 - DNA, 15 bp, Homo sapiens
gaacgttttgtagga

SEQ ID NO: 489874 - DNA, 15 bp, Homo sapiens
aacgttttgtaggat

SEQ ID NO: 489875 - DNA, 15 bp, Homo sapiens
acgttttgtaggatt

SEQ ID NO: 489876 - DNA, 15 bp, Homo sapiens
cgttttgtaggattc

SEQ ID NO: 489877 - DNA, 15 bp, Homo sapiens
gttttgtaggattca

SEQ ID NO: 489878 - DNA, 15 bp, Homo sapiens
ttttgtaggattcat

SEQ ID NO: 489879 - DNA, 15 bp, Homo sapiens
tttgtaggattcatt

SEQ ID NO: 489880 - DNA, 15 bp, Homo sapiens
ttgtaggattcattt

SEQ ID NO: 489881 - DNA, 15 bp, Homo sapiens
tgtaggattcatttg

SEQ ID NO: 489882 - DNA, 15 bp, Homo sapiens
gtaggattcatttgt

SEQ ID NO: 489883 - DNA, 15 bp, Homo sapiens
taggattcatttgtt

SEQ ID NO: 489884 - DNA, 15 bp, Homo sapiens
aggattcatttgttc

SEQ ID NO: 489885 - DNA, 15 bp, Homo sapiens
ggattcatttgttct

SEQ ID NO: 489886 - DNA, 15 bp, Homo sapiens
gattcatttgttctt

SEQ ID NO: 489887 - DNA, 15 bp, Homo sapiens
attcatttgttcttt

SEQ ID NO: 489888 - DNA, 15 bp, Homo sapiens
ttcatttgttctttt

SEQ ID NO: 489889 - DNA, 15 bp, Homo sapiens
tcatttgttcttttg

SEQ ID NO: 489890 - DNA, 15 bp, Homo sapiens
catttgttcttttgt

SEQ ID NO: 489891 - DNA, 15 bp, Homo sapiens
atttgttcttttgtc

SEQ ID NO: 489892 - DNA, 15 bp, Homo sapiens
tttgttcttttgtcc

SEQ ID NO: 489893 - DNA, 15 bp, Homo sapiens
ttgttcttttgtccc

SEQ ID NO: 489894 - DNA, 15 bp, Homo sapiens
tgttcttttgtccct

SEQ ID NO: 489895 - DNA, 15 bp, Homo sapiens
gttcttttgtccctt

SEQ ID NO: 489896 - DNA, 15 bp, Homo sapiens
ttcttttgtcccttt

SEQ ID NO: 489897 - DNA, 15 bp, Homo sapiens
tcttttgtcccttta

SEQ ID NO: 489898 - DNA, 15 bp, Homo sapiens
cttttgtccctttaa

SEQ ID NO: 489899 - DNA, 15 bp, Homo sapiens
ttttgtccctttaaa

SEQ ID NO: 489900 - DNA, 15 bp, Homo sapiens
tttgtccctttaaag

SEQ ID NO: 489901 - DNA, 15 bp, Homo sapiens
ttgtccctttaaagt

SEQ ID NO: 489902 - DNA, 15 bp, Homo sapiens
tgtccctttaaagtt

SEQ ID NO: 489903 - DNA, 15 bp, Homo sapiens
gtccctttaaagttg

SEQ ID NO: 489904 - DNA, 15 bp, Homo sapiens
tccctttaaagttgc

SEQ ID NO: 489905 - DNA, 15 bp, Homo sapiens
ccctttaaagttgct

SEQ ID NO: 489906 - DNA, 15 bp, Homo sapiens
cctttaaagttgctc

SEQ ID NO: 489907 - DNA, 15 bp, Homo sapiens
ctttaaagttgctca

SEQ ID NO: 489908 - DNA, 15 bp, Homo sapiens
tttaaagttgctcag

SEQ ID NO: 489909 - DNA, 15 bp, Homo sapiens
ttaaagttgctcagc

SEQ ID NO: 489910 - DNA, 15 bp, Homo sapiens
taaagttgctcagcc

SEQ ID NO: 489911 - DNA, 15 bp, Homo sapiens
aaagttgctcagcca

SEQ ID NO: 489912 - DNA, 15 bp, Homo sapiens
aagttgctcagccag

SEQ ID NO: 489913 - DNA, 15 bp, Homo sapiens
agttgctcagccagc

SEQ ID NO: 489914 - DNA, 15 bp, Homo sapiens
gttgctcagccagca

SEQ ID NO: 489915 - DNA, 15 bp, Homo sapiens
ttgctcagccagcaa

SEQ ID NO: 489916 - DNA, 15 bp, Homo sapiens
tgctcagccagcaaa

SEQ ID NO: 489917 - DNA, 15 bp, Homo sapiens
gctcagccagcaaat

SEQ ID NO: 489918 - DNA, 15 bp, Homo sapiens
ctcagccagcaaata

SEQ ID NO: 489919 - DNA, 15 bp, Homo sapiens
tcagccagcaaatat

SEQ ID NO: 489920 - DNA, 15 bp, Homo sapiens
cagccagcaaatatt

SEQ ID NO: 489921 - DNA, 15 bp, Homo sapiens
agccagcaaatattt

SEQ ID NO: 489922 - DNA, 15 bp, Homo sapiens
gccagcaaatatttt

SEQ ID NO: 489923 - DNA, 15 bp, Homo sapiens
ccagcaaatatttta

SEQ ID NO: 489924 - DNA, 15 bp, Homo sapiens
cagcaaatattttaa

SEQ ID NO: 489925 - DNA, 15 bp, Homo sapiens
agcaaatattttaat

SEQ ID NO: 489926 - DNA, 15 bp, Homo sapiens
gcaaatattttaata

SEQ ID NO: 489927 - DNA, 15 bp, Homo sapiens
caaatattttaataa

SEQ ID NO: 489928 - DNA, 15 bp, Homo sapiens
aaatattttaataag

SEQ ID NO: 489929 - DNA, 15 bp, Homo sapiens
aatattttaataagc

SEQ ID NO: 489930 - DNA, 15 bp, Homo sapiens
atattttaataagcc

SEQ ID NO: 489931 - DNA, 15 bp, Homo sapiens
tattttaataagcct

SEQ ID NO: 489932 - DNA, 15 bp, Homo sapiens
attttaataagcctt

SEQ ID NO: 489933 - DNA, 15 bp, Homo sapiens
ttttaataagccttt

SEQ ID NO: 489934 - DNA, 15 bp, Homo sapiens
tttaataagcctttg

SEQ ID NO: 489935 - DNA, 15 bp, Homo sapiens
ttaataagcctttgt

SEQ ID NO: 489936 - DNA, 15 bp, Homo sapiens
taataagcctttgtg

SEQ ID NO: 489937 - DNA, 15 bp, Homo sapiens
aataagcctttgtga

SEQ ID NO: 489938 - DNA, 15 bp, Homo sapiens
ataagcctttgtgat

SEQ ID NO: 489939 - DNA, 15 bp, Homo sapiens
taagcctttgtgatt

SEQ ID NO: 489940 - DNA, 15 bp, Homo sapiens
aagcctttgtgattc

SEQ ID NO: 489941 - DNA, 15 bp, Homo sapiens
agcctttgtgattcc

SEQ ID NO: 489942 - DNA, 15 bp, Homo sapiens
gcctttgtgattccc

SEQ ID NO: 489943 - DNA, 15 bp, Homo sapiens
cctttgtgattccca

SEQ ID NO: 489944 - DNA, 15 bp, Homo sapiens
ctttgtgattcccaa

SEQ ID NO: 489945 - DNA, 15 bp, Homo sapiens
tttgtgattcccaaa

SEQ ID NO: 489946 - DNA, 15 bp, Homo sapiens
ttgtgattcccaaag

SEQ ID NO: 489947 - DNA, 15 bp, Homo sapiens
tgtgattcccaaagc

SEQ ID NO: 489948 - DNA, 15 bp, Homo sapiens
gtgattcccaaagct

SEQ ID NO: 489949 - DNA, 15 bp, Homo sapiens
tgattcccaaagctt

SEQ ID NO: 489950 - DNA, 15 bp, Homo sapiens
gattcccaaagctta

SEQ ID NO: 489951 - DNA, 15 bp, Homo sapiens
attcccaaagcttac

SEQ ID NO: 489952 - DNA, 15 bp, Homo sapiens
ttcccaaagcttacc

SEQ ID NO: 489953 - DNA, 15 bp, Homo sapiens
tcccaaagcttacca

SEQ ID NO: 489954 - DNA, 15 bp, Homo sapiens
cccaaagcttaccaa

SEQ ID NO: 489955 - DNA, 15 bp, Homo sapiens
ccaaagcttaccaac

SEQ ID NO: 489956 - DNA, 15 bp, Homo sapiens
caaagcttaccaacc

SEQ ID NO: 489957 - DNA, 15 bp, Homo sapiens
aaagcttaccaacca

SEQ ID NO: 489958 - DNA, 15 bp, Homo sapiens
aagcttaccaaccac

SEQ ID NO: 489959 - DNA, 15 bp, Homo sapiens
agcttaccaaccacc

SEQ ID NO: 489960 - DNA, 15 bp, Homo sapiens
gcttaccaaccacct

SEQ ID NO: 489961 - DNA, 15 bp, Homo sapiens
cttaccaaccacctt

SEQ ID NO: 489962 - DNA, 15 bp, Homo sapiens
ttaccaaccaccttt

SEQ ID NO: 489963 - DNA, 15 bp, Homo sapiens
taccaaccacctttg

SEQ ID NO: 489964 - DNA, 15 bp, Homo sapiens
accaaccacctttgg

SEQ ID NO: 489965 - DNA, 15 bp, Homo sapiens
ccaaccacctttgga

SEQ ID NO: 489966 - DNA, 15 bp, Homo sapiens
caaccacctttggag

SEQ ID NO: 489967 - DNA, 15 bp, Homo sapiens
aaccacctttggaga

SEQ ID NO: 489968 - DNA, 15 bp, Homo sapiens
accacctttggagaa

SEQ ID NO: 489969 - DNA, 15 bp, Homo sapiens
ccacctttggagaat

SEQ ID NO: 489970 - DNA, 15 bp, Homo sapiens
cacctttggagaatt

SEQ ID NO: 489971 - DNA, 15 bp, Homo sapiens
acctttggagaattt

SEQ ID NO: 489972 - DNA, 15 bp, Homo sapiens
cctttggagaattta

SEQ ID NO: 489973 - DNA, 15 bp, Homo sapiens
ctttggagaatttat

SEQ ID NO: 489974 - DNA, 15 bp, Homo sapiens
tttggagaatttatc

SEQ ID NO: 489975 - DNA, 15 bp, Homo sapiens
ttggagaatttatct

SEQ ID NO: 489976 - DNA, 15 bp, Homo sapiens
tggagaatttatcta

SEQ ID NO: 489977 - DNA, 15 bp, Homo sapiens
ggagaatttatctaa

SEQ ID NO: 489978 - DNA, 15 bp, Homo sapiens
gagaatttatctaaa

SEQ ID NO: 489979 - DNA, 15 bp, Homo sapiens
agaatttatctaaac

SEQ ID NO: 489980 - DNA, 15 bp, Homo sapiens
gaatttatctaaaca

SEQ ID NO: 489981 - DNA, 15 bp, Homo sapiens
aatttatctaaacaa

SEQ ID NO: 489982 - DNA, 15 bp, Homo sapiens
atttatctaaacaaa

SEQ ID NO: 489983 - DNA, 15 bp, Homo sapiens
tttatctaaacaaat

SEQ ID NO: 489984 - DNA, 15 bp, Homo sapiens
ttatctaaacaaatc

SEQ ID NO: 489985 - DNA, 15 bp, Homo sapiens
tatctaaacaaatcg

SEQ ID NO: 489986 - DNA, 15 bp, Homo sapiens
atctaaacaaatcgg

SEQ ID NO: 489987 - DNA, 15 bp, Homo sapiens
tctaaacaaatcgga

SEQ ID NO: 489988 - DNA, 15 bp, Homo sapiens
ctaaacaaatcggat

SEQ ID NO: 489989 - DNA, 15 bp, Homo sapiens
taaacaaatcggatt

SEQ ID NO: 489990 - DNA, 15 bp, Homo sapiens
aaacaaatcggattg

SEQ ID NO: 489991 - DNA, 15 bp, Homo sapiens
aacaaatcggattgg

SEQ ID NO: 489992 - DNA, 15 bp, Homo sapiens
acaaatcggattggc

SEQ ID NO: 489993 - DNA, 15 bp, Homo sapiens
caaatcggattggca

SEQ ID NO: 489994 - DNA, 15 bp, Homo sapiens
aaatcggattggcac

SEQ ID NO: 489995 - DNA, 15 bp, Homo sapiens
aatcggattggcacc

SEQ ID NO: 489996 - DNA, 15 bp, Homo sapiens
atcggattggcaccc

SEQ ID NO: 489997 - DNA, 15 bp, Homo sapiens
tcggattggcaccct

SEQ ID NO: 489998 - DNA, 15 bp, Homo sapiens
cggattggcaccctc

SEQ ID NO: 489999 - DNA, 15 bp, Homo sapiens
ggattggcaccctcc

SEQ ID NO: 490000 - DNA, 15 bp, Homo sapiens
gattggcaccctccc

SEQ ID NO: 490001 - DNA, 15 bp, Homo sapiens
attggcaccctccca

SEQ ID NO: 490002 - DNA, 15 bp, Homo sapiens
ttggcaccctcccaa

SEQ ID NO: 490003 - DNA, 15 bp, Homo sapiens
tggcaccctcccaat

SEQ ID NO: 490004 - DNA, 15 bp, Homo sapiens
ggcaccctcccaatg

SEQ ID NO: 490005 - DNA, 15 bp, Homo sapiens
gcaccctcccaatgc

SEQ ID NO: 490006 - DNA, 15 bp, Homo sapiens
caccctcccaatgcc

SEQ ID NO: 490007 - DNA, 15 bp, Homo sapiens
accctcccaatgcca

SEQ ID NO: 490008 - DNA, 15 bp, Homo sapiens
ccctcccaatgccaa

SEQ ID NO: 490009 - DNA, 15 bp, Homo sapiens
cctcccaatgccaag

SEQ ID NO: 490010 - DNA, 15 bp, Homo sapiens
ctcccaatgccaagc

SEQ ID NO: 490011 - DNA, 15 bp, Homo sapiens
tcccaatgccaagcc

SEQ ID NO: 490012 - DNA, 15 bp, Homo sapiens
cccaatgccaagcca

SEQ ID NO: 490013 - DNA, 15 bp, Homo sapiens
ccaatgccaagccaa

SEQ ID NO: 490014 - DNA, 15 bp, Homo sapiens
caatgccaagccaat

SEQ ID NO: 490015 - DNA, 15 bp, Homo sapiens
aatgccaagccaatc

SEQ ID NO: 490016 - DNA, 15 bp, Homo sapiens
atgccaagccaatcc

SEQ ID NO: 490017 - DNA, 15 bp, Homo sapiens
tgccaagccaatccc

SEQ ID NO: 490018 - DNA, 15 bp, Homo sapiens
gccaagccaatccct

SEQ ID NO: 490019 - DNA, 15 bp, Homo sapiens
ccaagccaatccctt

SEQ ID NO: 490020 - DNA, 15 bp, Homo sapiens
caagccaatcccttg

SEQ ID NO: 490021 - DNA, 15 bp, Homo sapiens
aagccaatcccttga

SEQ ID NO: 490022 - DNA, 15 bp, Homo sapiens
agccaatcccttgag

SEQ ID NO: 490023 - DNA, 15 bp, Homo sapiens
gccaatcccttgagc

SEQ ID NO: 490024 - DNA, 15 bp, Homo sapiens
ccaatcccttgagcc

SEQ ID NO: 490025 - DNA, 15 bp, Homo sapiens
caatcccttgagccc

SEQ ID NO: 490026 - DNA, 15 bp, Homo sapiens
aatcccttgagcccc

SEQ ID NO: 490027 - DNA, 15 bp, Homo sapiens
atcccttgagcccct

SEQ ID NO: 490028 - DNA, 15 bp, Homo sapiens
tcccttgagcccctg

SEQ ID NO: 490029 - DNA, 15 bp, Homo sapiens
cccttgagcccctgt

SEQ ID NO: 490030 - DNA, 15 bp, Homo sapiens
ccttgagcccctgta

SEQ ID NO: 490031 - DNA, 15 bp, Homo sapiens
cttgagcccctgtaa

SEQ ID NO: 490032 - DNA, 15 bp, Homo sapiens
ttgagcccctgtaac

SEQ ID NO: 490033 - DNA, 15 bp, Homo sapiens
tgagcccctgtaact

SEQ ID NO: 490034 - DNA, 15 bp, Homo sapiens
gagcccctgtaacta

SEQ ID NO: 490035 - DNA, 15 bp, Homo sapiens
agcccctgtaactaa

SEQ ID NO: 490036 - DNA, 15 bp, Homo sapiens
gcccctgtaactaat

SEQ ID NO: 490037 - DNA, 15 bp, Homo sapiens
cccctgtaactaatg

SEQ ID NO: 490038 - DNA, 15 bp, Homo sapiens
ccctgtaactaatga

SEQ ID NO: 490039 - DNA, 15 bp, Homo sapiens
cctgtaactaatgag

SEQ ID NO: 490040 - DNA, 15 bp, Homo sapiens
ctgtaactaatgaga

SEQ ID NO: 490041 - DNA, 15 bp, Homo sapiens
tgtaactaatgagaa

SEQ ID NO: 490042 - DNA, 15 bp, Homo sapiens
gtaactaatgagaac

SEQ ID NO: 490043 - DNA, 15 bp, Homo sapiens
taactaatgagaact

SEQ ID NO: 490044 - DNA, 15 bp, Homo sapiens
aactaatgagaactt

SEQ ID NO: 490045 - DNA, 15 bp, Homo sapiens
actaatgagaacttt

SEQ ID NO: 490046 - DNA, 15 bp, Homo sapiens
ctaatgagaacttta

SEQ ID NO: 490047 - DNA, 15 bp, Homo sapiens
taatgagaactttaa

SEQ ID NO: 490048 - DNA, 15 bp, Homo sapiens
aatgagaactttaaa

SEQ ID NO: 490049 - DNA, 15 bp, Homo sapiens
atgagaactttaaaa

SEQ ID NO: 490050 - DNA, 15 bp, Homo sapiens
tgagaactttaaaaa

SEQ ID NO: 490051 - DNA, 15 bp, Homo sapiens
gagaactttaaaaat

SEQ ID NO: 490052 - DNA, 15 bp, Homo sapiens
agaactttaaaaatg

SEQ ID NO: 490053 - DNA, 15 bp, Homo sapiens
gaactttaaaaatgc

SEQ ID NO: 490054 - DNA, 15 bp, Homo sapiens
aactttaaaaatgct

SEQ ID NO: 490055 - DNA, 15 bp, Homo sapiens
actttaaaaatgctt

SEQ ID NO: 490056 - DNA, 15 bp, Homo sapiens
ctttaaaaatgcttg

SEQ ID NO: 490057 - DNA, 15 bp, Homo sapiens
tttaaaaatgcttgt

SEQ ID NO: 490058 - DNA, 15 bp, Homo sapiens
ttaaaaatgcttgtc

SEQ ID NO: 490059 - DNA, 15 bp, Homo sapiens
taaaaatgcttgtcg

SEQ ID NO: 490060 - DNA, 15 bp, Homo sapiens
aaaaatgcttgtcgc

SEQ ID NO: 490061 - DNA, 15 bp, Homo sapiens
aaaatgcttgtcgcc

SEQ ID NO: 490062 - DNA, 15 bp, Homo sapiens
aaatgcttgtcgcca

SEQ ID NO: 490063 - DNA, 15 bp, Homo sapiens
aatgcttgtcgccag

SEQ ID NO: 490064 - DNA, 15 bp, Homo sapiens
atgcttgtcgccagc

SEQ ID NO: 490065 - DNA, 15 bp, Homo sapiens
tgcttgtcgccagca

SEQ ID NO: 490066 - DNA, 15 bp, Homo sapiens
gcttgtcgccagcat

SEQ ID NO: 490067 - DNA, 15 bp, Homo sapiens
cttgtcgccagcata

SEQ ID NO: 490068 - DNA, 15 bp, Homo sapiens
ttgtcgccagcatac

SEQ ID NO: 490069 - DNA, 15 bp, Homo sapiens
tgtcgccagcataca

SEQ ID NO: 490070 - DNA, 15 bp, Homo sapiens
gtcgccagcatacaa

SEQ ID NO: 490071 - DNA, 15 bp, Homo sapiens
tcgccagcatacaat

SEQ ID NO: 490072 - DNA, 15 bp, Homo sapiens
cgccagcatacaatg

SEQ ID NO: 490073 - DNA, 15 bp, Homo sapiens
gccagcatacaatga

SEQ ID NO: 490074 - DNA, 15 bp, Homo sapiens
ccagcatacaatgaa

SEQ ID NO: 490075 - DNA, 15 bp, Homo sapiens
cagcatacaatgaat

SEQ ID NO: 490076 - DNA, 15 bp, Homo sapiens
agcatacaatgaatt

SEQ ID NO: 490077 - DNA, 15 bp, Homo sapiens
gcatacaatgaattg

SEQ ID NO: 490078 - DNA, 15 bp, Homo sapiens
catacaatgaattga

SEQ ID NO: 490079 - DNA, 15 bp, Homo sapiens
atacaatgaattgat

SEQ ID NO: 490080 - DNA, 15 bp, Homo sapiens
tacaatgaattgatc

SEQ ID NO: 490081 - DNA, 15 bp, Homo sapiens
acaatgaattgatct

SEQ ID NO: 490082 - DNA, 15 bp, Homo sapiens
caatgaattgatctt

SEQ ID NO: 490083 - DNA, 15 bp, Homo sapiens
aatgaattgatcttc

SEQ ID NO: 490084 - DNA, 15 bp, Homo sapiens
atgaattgatcttca

SEQ ID NO: 490085 - DNA, 15 bp, Homo sapiens
tgaattgatcttcat

SEQ ID NO: 490086 - DNA, 15 bp, Homo sapiens
gaattgatcttcatg

SEQ ID NO: 490087 - DNA, 15 bp, Homo sapiens
aattgatcttcatgt

SEQ ID NO: 490088 - DNA, 15 bp, Homo sapiens
attgatcttcatgtt

SEQ ID NO: 490089 - DNA, 15 bp, Homo sapiens
ttgatcttcatgtta

SEQ ID NO: 490090 - DNA, 15 bp, Homo sapiens
tgatcttcatgttaa

SEQ ID NO: 490091 - DNA, 15 bp, Homo sapiens
gatcttcatgttaat

SEQ ID NO: 490092 - DNA, 15 bp, Homo sapiens
atcttcatgttaatc

SEQ ID NO: 490093 - DNA, 15 bp, Homo sapiens
tcttcatgttaatct

SEQ ID NO: 490094 - DNA, 15 bp, Homo sapiens
cttcatgttaatctt

SEQ ID NO: 490095 - DNA, 15 bp, Homo sapiens
ttcatgttaatcttg

SEQ ID NO: 490096 - DNA, 15 bp, Homo sapiens
tcatgttaatcttga

SEQ ID NO: 490097 - DNA, 15 bp, Homo sapiens
catgttaatcttgac

SEQ ID NO: 490098 - DNA, 15 bp, Homo sapiens
atgttaatcttgact

SEQ ID NO: 490099 - DNA, 15 bp, Homo sapiens
tgttaatcttgactt

SEQ ID NO: 490100 - DNA, 15 bp, Homo sapiens
gttaatcttgacttt

SEQ ID NO: 490101 - DNA, 15 bp, Homo sapiens
ttaatcttgactttt

SEQ ID NO: 490102 - DNA, 15 bp, Homo sapiens
taatcttgacttttg

SEQ ID NO: 490103 - DNA, 15 bp, Homo sapiens
aatcttgacttttga

SEQ ID NO: 490104 - DNA, 15 bp, Homo sapiens
atcttgacttttgat

SEQ ID NO: 490105 - DNA, 15 bp, Homo sapiens
tcttgacttttgatc

SEQ ID NO: 490106 - DNA, 15 bp, Homo sapiens
cttgacttttgatcc

SEQ ID NO: 490107 - DNA, 15 bp, Homo sapiens
ttgacttttgatcct

SEQ ID NO: 490108 - DNA, 15 bp, Homo sapiens
tgacttttgatcctt

SEQ ID NO: 490109 - DNA, 15 bp, Homo sapiens
gacttttgatccttt

SEQ ID NO: 490110 - DNA, 15 bp, Homo sapiens
acttttgatcctttg

SEQ ID NO: 490111 - DNA, 15 bp, Homo sapiens
cttttgatcctttgt

SEQ ID NO: 490112 - DNA, 15 bp, Homo sapiens
ttttgatcctttgtg

SEQ ID NO: 490113 - DNA, 15 bp, Homo sapiens
tttgatcctttgtgg

SEQ ID NO: 490114 - DNA, 15 bp, Homo sapiens
ttgatcctttgtgga

SEQ ID NO: 490115 - DNA, 15 bp, Homo sapiens
tgatcctttgtggat

SEQ ID NO: 490116 - DNA, 15 bp, Homo sapiens
gatcctttgtggatt

SEQ ID NO: 490117 - DNA, 15 bp, Homo sapiens
atcctttgtggatta

SEQ ID NO: 490118 - DNA, 15 bp, Homo sapiens
tcctttgtggattaa

SEQ ID NO: 490119 - DNA, 15 bp, Homo sapiens
cctttgtggattaaa

SEQ ID NO: 490120 - DNA, 15 bp, Homo sapiens
ctttgtggattaaaa

SEQ ID NO: 490121 - DNA, 15 bp, Homo sapiens
tttgtggattaaaaa

SEQ ID NO: 490122 - DNA, 15 bp, Homo sapiens
ttgtggattaaaaat

SEQ ID NO: 490123 - DNA, 15 bp, Homo sapiens
tgtggattaaaaatt

SEQ ID NO: 490124 - DNA, 15 bp, Homo sapiens
gtggattaaaaatta

SEQ ID NO: 490125 - DNA, 15 bp, Homo sapiens
tggattaaaaattag

SEQ ID NO: 490126 - DNA, 15 bp, Homo sapiens
ggattaaaaattagc

SEQ ID NO: 490127 - DNA, 15 bp, Homo sapiens
gattaaaaattagca

SEQ ID NO: 490128 - DNA, 15 bp, Homo sapiens
attaaaaattagcat

SEQ ID NO: 490129 - DNA, 15 bp, Homo sapiens
ttaaaaattagcatg

SEQ ID NO: 490130 - DNA, 15 bp, Homo sapiens
taaaaattagcatgg

SEQ ID NO: 490131 - DNA, 15 bp, Homo sapiens
aaaaattagcatggc

SEQ ID NO: 490132 - DNA, 15 bp, Homo sapiens
aaaattagcatggcc

SEQ ID NO: 490133 - DNA, 15 bp, Homo sapiens
aaattagcatggccc

SEQ ID NO: 490134 - DNA, 15 bp, Homo sapiens
aattagcatggcccc

SEQ ID NO: 490135 - DNA, 15 bp, Homo sapiens
attagcatggcccca

SEQ ID NO: 490136 - DNA, 15 bp, Homo sapiens
ttagcatggccccaa

SEQ ID NO: 490137 - DNA, 15 bp, Homo sapiens
tagcatggccccaaa

SEQ ID NO: 490138 - DNA, 15 bp, Homo sapiens
agcatggccccaaat

SEQ ID NO: 490139 - DNA, 15 bp, Homo sapiens
gcatggccccaaatg

SEQ ID NO: 490140 - DNA, 15 bp, Homo sapiens
catggccccaaatga

SEQ ID NO: 490141 - DNA, 15 bp, Homo sapiens
atggccccaaatgaa

SEQ ID NO: 490142 - DNA, 15 bp, Homo sapiens
tggccccaaatgaat

SEQ ID NO: 490143 - DNA, 15 bp, Homo sapiens
ggccccaaatgaatt

SEQ ID NO: 490144 - DNA, 15 bp, Homo sapiens
gccccaaatgaattt

SEQ ID NO: 490145 - DNA, 15 bp, Homo sapiens
ccccaaatgaatttc

SEQ ID NO: 490146 - DNA, 15 bp, Homo sapiens
cccaaatgaatttcc

SEQ ID NO: 490147 - DNA, 15 bp, Homo sapiens
ccaaatgaatttcca

SEQ ID NO: 490148 - DNA, 15 bp, Homo sapiens
caaatgaatttccac

SEQ ID NO: 490149 - DNA, 15 bp, Homo sapiens
aaatgaatttccact

SEQ ID NO: 490150 - DNA, 15 bp, Homo sapiens
aatgaatttccactc

SEQ ID NO: 490151 - DNA, 15 bp, Homo sapiens
atgaatttccactct

SEQ ID NO: 490152 - DNA, 15 bp, Homo sapiens
tgaatttccactctt

SEQ ID NO: 490153 - DNA, 15 bp, Homo sapiens
gaatttccactcttg

SEQ ID NO: 490154 - DNA, 15 bp, Homo sapiens
aatttccactcttgg

SEQ ID NO: 490155 - DNA, 15 bp, Homo sapiens
atttccactcttggc

SEQ ID NO: 490156 - DNA, 15 bp, Homo sapiens
tttccactcttggca

SEQ ID NO: 490157 - DNA, 15 bp, Homo sapiens
ttccactcttggcaa

SEQ ID NO: 490158 - DNA, 15 bp, Homo sapiens
tccactcttggcaat

SEQ ID NO: 490159 - DNA, 15 bp, Homo sapiens
ccactcttggcaatc

SEQ ID NO: 490160 - DNA, 15 bp, Homo sapiens
cactcttggcaatct

SEQ ID NO: 490161 - DNA, 15 bp, Homo sapiens
actcttggcaatctt

SEQ ID NO: 490162 - DNA, 15 bp, Homo sapiens
ctcttggcaatcttg

SEQ ID NO: 490163 - DNA, 15 bp, Homo sapiens
tcttggcaatcttgg

SEQ ID NO: 490164 - DNA, 15 bp, Homo sapiens
cttggcaatcttgga

SEQ ID NO: 490165 - DNA, 15 bp, Homo sapiens
ttggcaatcttggaa

SEQ ID NO: 490166 - DNA, 15 bp, Homo sapiens
tggcaatcttggaat

SEQ ID NO: 490167 - DNA, 15 bp, Homo sapiens
ggcaatcttggaatt

SEQ ID NO: 490168 - DNA, 15 bp, Homo sapiens
gcaatcttggaatta

SEQ ID NO: 490169 - DNA, 15 bp, Homo sapiens
caatcttggaattaa

SEQ ID NO: 490170 - DNA, 15 bp, Homo sapiens
aatcttggaattaaa

SEQ ID NO: 490171 - DNA, 15 bp, Homo sapiens
atcttggaattaaaa

SEQ ID NO: 490172 - DNA, 15 bp, Homo sapiens
tcttggaattaaaat

SEQ ID NO: 490173 - DNA, 15 bp, Homo sapiens
cttggaattaaaatg

SEQ ID NO: 490174 - DNA, 15 bp, Homo sapiens
ttggaattaaaatga

SEQ ID NO: 490175 - DNA, 15 bp, Homo sapiens
tggaattaaaatgaa

SEQ ID NO: 490176 - DNA, 15 bp, Homo sapiens
ggaattaaaatgaaa

SEQ ID NO: 490177 - DNA, 15 bp, Homo sapiens
attaaaatgaaactc

SEQ ID NO: 490178 - DNA, 15 bp, Homo sapiens
ttaaaatgaaactct

SEQ ID NO: 490179 - DNA, 15 bp, Homo sapiens
taaaatgaaactctg

SEQ ID NO: 490180 - DNA, 15 bp, Homo sapiens
aaaatgaaactctgt

SEQ ID NO: 490181 - DNA, 15 bp, Homo sapiens
aaatgaaactctgta

SEQ ID NO: 490182 - DNA, 15 bp, Homo sapiens
aatgaaactctgtat

SEQ ID NO: 490183 - DNA, 15 bp, Homo sapiens
atgaaactctgtatt

SEQ ID NO: 490184 - DNA, 15 bp, Homo sapiens
tgaaactctgtattc

SEQ ID NO: 490185 - DNA, 15 bp, Homo sapiens
gaaactctgtattca

SEQ ID NO: 490186 - DNA, 15 bp, Homo sapiens
aaactctgtattcat

SEQ ID NO: 490187 - DNA, 15 bp, Homo sapiens
aactctgtattcata

SEQ ID NO: 490188 - DNA, 15 bp, Homo sapiens
actctgtattcataa

SEQ ID NO: 490189 - DNA, 15 bp, Homo sapiens
ctctgtattcataaa

SEQ ID NO: 490190 - DNA, 15 bp, Homo sapiens
tctgtattcataaat

SEQ ID NO: 490191 - DNA, 15 bp, Homo sapiens
ctgtattcataaatc

SEQ ID NO: 490192 - DNA, 15 bp, Homo sapiens
tgtattcataaatcc

SEQ ID NO: 490193 - DNA, 15 bp, Homo sapiens
gtattcataaatcct

SEQ ID NO: 490194 - DNA, 15 bp, Homo sapiens
tattcataaatccta

SEQ ID NO: 490195 - DNA, 15 bp, Homo sapiens
attcataaatcctaa

SEQ ID NO: 490196 - DNA, 15 bp, Homo sapiens
ttcataaatcctaat

SEQ ID NO: 490197 - DNA, 15 bp, Homo sapiens
tcataaatcctaatt

SEQ ID NO: 490198 - DNA, 15 bp, Homo sapiens
cataaatcctaattg

SEQ ID NO: 490199 - DNA, 15 bp, Homo sapiens
ataaatcctaattgt

SEQ ID NO: 490200 - DNA, 15 bp, Homo sapiens
taaatcctaattgtg

SEQ ID NO: 490201 - DNA, 15 bp, Homo sapiens
aaatcctaattgtgt

SEQ ID NO: 490202 - DNA, 15 bp, Homo sapiens
aatcctaattgtgtg

SEQ ID NO: 490203 - DNA, 15 bp, Homo sapiens
atcctaattgtgtga

SEQ ID NO: 490204 - DNA, 15 bp, Homo sapiens
tcctaattgtgtgaa

SEQ ID NO: 490205 - DNA, 15 bp, Homo sapiens
cctaattgtgtgaat

SEQ ID NO: 490206 - DNA, 15 bp, Homo sapiens
ctaattgtgtgaatt

SEQ ID NO: 490207 - DNA, 15 bp, Homo sapiens
taattgtgtgaattg

SEQ ID NO: 490208 - DNA, 15 bp, Homo sapiens
aattgtgtgaattgc

SEQ ID NO: 490209 - DNA, 15 bp, Homo sapiens
attgtgtgaattgcc

SEQ ID NO: 490210 - DNA, 15 bp, Homo sapiens
ttgtgtgaattgcct

SEQ ID NO: 490211 - DNA, 15 bp, Homo sapiens
tgtgtgaattgccta

SEQ ID NO: 490212 - DNA, 15 bp, Homo sapiens
gtgtgaattgcctat

SEQ ID NO: 490213 - DNA, 15 bp, Homo sapiens
tgtgaattgcctatt

SEQ ID NO: 490214 - DNA, 15 bp, Homo sapiens
gtgaattgcctattt

SEQ ID NO: 490215 - DNA, 15 bp, Homo sapiens
tgaattgcctatttt

SEQ ID NO: 490216 - DNA, 15 bp, Homo sapiens
gaattgcctatttta

SEQ ID NO: 490217 - DNA, 15 bp, Homo sapiens
aattgcctattttaa

SEQ ID NO: 490218 - DNA, 15 bp, Homo sapiens
attgcctattttaac

SEQ ID NO: 490219 - DNA, 15 bp, Homo sapiens
ttgcctattttaaca

SEQ ID NO: 490220 - DNA, 15 bp, Homo sapiens
tgcctattttaacat

SEQ ID NO: 490221 - DNA, 15 bp, Homo sapiens
gcctattttaacatg

SEQ ID NO: 490222 - DNA, 15 bp, Homo sapiens
cctattttaacatga

SEQ ID NO: 490223 - DNA, 15 bp, Homo sapiens
ctattttaacatgac

SEQ ID NO: 490224 - DNA, 15 bp, Homo sapiens
tattttaacatgacc

SEQ ID NO: 490225 - DNA, 15 bp, Homo sapiens
attttaacatgaccg

SEQ ID NO: 490226 - DNA, 15 bp, Homo sapiens
ttttaacatgaccgt

SEQ ID NO: 490227 - DNA, 15 bp, Homo sapiens
tttaacatgaccgtt

SEQ ID NO: 490228 - DNA, 15 bp, Homo sapiens
ttaacatgaccgttt

SEQ ID NO: 490229 - DNA, 15 bp, Homo sapiens
taacatgaccgtttt

SEQ ID NO: 490230 - DNA, 15 bp, Homo sapiens
aacatgaccgttttt

SEQ ID NO: 490231 - DNA, 15 bp, Homo sapiens
acatgaccgtttttt

SEQ ID NO: 490232 - DNA, 15 bp, Homo sapiens
catgaccgtttttta

SEQ ID NO: 490233 - DNA, 15 bp, Homo sapiens
atgaccgttttttaa

SEQ ID NO: 490234 - DNA, 15 bp, Homo sapiens
tgaccgttttttaac

SEQ ID NO: 490235 - DNA, 15 bp, Homo sapiens
gaccgttttttaact

SEQ ID NO: 490236 - DNA, 15 bp, Homo sapiens
accgttttttaactg

SEQ ID NO: 490237 - DNA, 15 bp, Homo sapiens
ccgttttttaactgt

SEQ ID NO: 490238 - DNA, 15 bp, Homo sapiens
cgttttttaactgtg

SEQ ID NO: 490239 - DNA, 15 bp, Homo sapiens
gttttttaactgtgt

SEQ ID NO: 490240 - DNA, 15 bp, Homo sapiens
ttttttaactgtgtc

SEQ ID NO: 490241 - DNA, 15 bp, Homo sapiens
tttttaactgtgtct

SEQ ID NO: 490242 - DNA, 15 bp, Homo sapiens
ttttaactgtgtcta

SEQ ID NO: 490243 - DNA, 15 bp, Homo sapiens
tttaactgtgtctac

SEQ ID NO: 490244 - DNA, 15 bp, Homo sapiens
ttaactgtgtctaca

SEQ ID NO: 490245 - DNA, 15 bp, Homo sapiens
taactgtgtctacac

SEQ ID NO: 490246 - DNA, 15 bp, Homo sapiens
aactgtgtctacaca

SEQ ID NO: 490247 - DNA, 15 bp, Homo sapiens
actgtgtctacacat

SEQ ID NO: 490248 - DNA, 15 bp, Homo sapiens
ctgtgtctacacatt

SEQ ID NO: 490249 - DNA, 15 bp, Homo sapiens
tgtgtctacacattg

SEQ ID NO: 490250 - DNA, 15 bp, Homo sapiens
gtgtctacacattgt

SEQ ID NO: 490251 - DNA, 15 bp, Homo sapiens
tgtctacacattgtt

SEQ ID NO: 490252 - DNA, 15 bp, Homo sapiens
gtctacacattgttg

SEQ ID NO: 490253 - DNA, 15 bp, Homo sapiens
tctacacattgttgc

SEQ ID NO: 490254 - DNA, 15 bp, Homo sapiens
ctacacattgttgca

SEQ ID NO: 490255 - DNA, 15 bp, Homo sapiens
tacacattgttgcac

SEQ ID NO: 490256 - DNA, 15 bp, Homo sapiens
acacattgttgcaca

SEQ ID NO: 490257 - DNA, 15 bp, Homo sapiens
cacattgttgcacat

SEQ ID NO: 490258 - DNA, 15 bp, Homo sapiens
acattgttgcacata

SEQ ID NO: 490259 - DNA, 15 bp, Homo sapiens
cattgttgcacataa

SEQ ID NO: 490260 - DNA, 15 bp, Homo sapiens
attgttgcacataac

SEQ ID NO: 490261 - DNA, 15 bp, Homo sapiens
ttgttgcacataaca

SEQ ID NO: 490262 - DNA, 15 bp, Homo sapiens
tgttgcacataacac

SEQ ID NO: 490263 - DNA, 15 bp, Homo sapiens
gttgcacataacact

SEQ ID NO: 490264 - DNA, 15 bp, Homo sapiens
ttgcacataacactt

SEQ ID NO: 490265 - DNA, 15 bp, Homo sapiens
tgcacataacacttt

SEQ ID NO: 490266 - DNA, 15 bp, Homo sapiens
gcacataacacttta

SEQ ID NO: 490267 - DNA, 15 bp, Homo sapiens
cacataacactttag

SEQ ID NO: 490268 - DNA, 15 bp, Homo sapiens
acataacactttaga

SEQ ID NO: 490269 - DNA, 15 bp, Homo sapiens
cataacactttagaa

SEQ ID NO: 490270 - DNA, 15 bp, Homo sapiens
ataacactttagaac

SEQ ID NO: 490271 - DNA, 15 bp, Homo sapiens
taacactttagaact

SEQ ID NO: 490272 - DNA, 15 bp, Homo sapiens
aacactttagaactc

SEQ ID NO: 490273 - DNA, 15 bp, Homo sapiens
acactttagaactcc

SEQ ID NO: 490274 - DNA, 15 bp, Homo sapiens
cactttagaactcct

SEQ ID NO: 490275 - DNA, 15 bp, Homo sapiens
actttagaactcctt

SEQ ID NO: 490276 - DNA, 15 bp, Homo sapiens
ctttagaactccttt

SEQ ID NO: 490277 - DNA, 15 bp, Homo sapiens
tttagaactcctttg

SEQ ID NO: 490278 - DNA, 15 bp, Homo sapiens
ttagaactcctttgt

SEQ ID NO: 490279 - DNA, 15 bp, Homo sapiens
tagaactcctttgtc

SEQ ID NO: 490280 - DNA, 15 bp, Homo sapiens
agaactcctttgtct

SEQ ID NO: 490281 - DNA, 15 bp, Homo sapiens
gaactcctttgtctg

SEQ ID NO: 490282 - DNA, 15 bp, Homo sapiens
aactcctttgtctga

SEQ ID NO: 490283 - DNA, 15 bp, Homo sapiens
actcctttgtctgaa

SEQ ID NO: 490284 - DNA, 15 bp, Homo sapiens
ctcctttgtctgaat

SEQ ID NO: 490285 - DNA, 15 bp, Homo sapiens
tcctttgtctgaatt

SEQ ID NO: 490286 - DNA, 15 bp, Homo sapiens
cctttgtctgaatta

SEQ ID NO: 490287 - DNA, 15 bp, Homo sapiens
ctttgtctgaattaa

SEQ ID NO: 490288 - DNA, 15 bp, Homo sapiens
tttgtctgaattaat

SEQ ID NO: 490289 - DNA, 15 bp, Homo sapiens
ttgtctgaattaata

SEQ ID NO: 490290 - DNA, 15 bp, Homo sapiens
tgtctgaattaatat

SEQ ID NO: 490291 - DNA, 15 bp, Homo sapiens
gtctgaattaatatc

SEQ ID NO: 490292 - DNA, 15 bp, Homo sapiens
tctgaattaatatcc

SEQ ID NO: 490293 - DNA, 15 bp, Homo sapiens
ctgaattaatatccc

SEQ ID NO: 490294 - DNA, 15 bp, Homo sapiens
tgaattaatatccca

SEQ ID NO: 490295 - DNA, 15 bp, Homo sapiens
gaattaatatcccag

SEQ ID NO: 490296 - DNA, 15 bp, Homo sapiens
aattaatatcccagt

SEQ ID NO: 490297 - DNA, 15 bp, Homo sapiens
attaatatcccagtt

SEQ ID NO: 490298 - DNA, 15 bp, Homo sapiens
ttaatatcccagttg

SEQ ID NO: 490299 - DNA, 15 bp, Homo sapiens
taatatcccagttgg

SEQ ID NO: 490300 - DNA, 15 bp, Homo sapiens
aatatcccagttggt

SEQ ID NO: 490301 - DNA, 15 bp, Homo sapiens
atatcccagttggtc

SEQ ID NO: 490302 - DNA, 15 bp, Homo sapiens
tatcccagttggtcc

SEQ ID NO: 490303 - DNA, 15 bp, Homo sapiens
atcccagttggtcct

SEQ ID NO: 490304 - DNA, 15 bp, Homo sapiens
tcccagttggtcctg

SEQ ID NO: 490305 - DNA, 15 bp, Homo sapiens
cccagttggtcctga

SEQ ID NO: 490306 - DNA, 15 bp, Homo sapiens
ccagttggtcctgat

SEQ ID NO: 490307 - DNA, 15 bp, Homo sapiens
cagttggtcctgata

SEQ ID NO: 490308 - DNA, 15 bp, Homo sapiens
agttggtcctgatag

SEQ ID NO: 490309 - DNA, 15 bp, Homo sapiens
gttggtcctgatagc

SEQ ID NO: 490310 - DNA, 15 bp, Homo sapiens
ttggtcctgatagca

SEQ ID NO: 490311 - DNA, 15 bp, Homo sapiens
tggtcctgatagcat

SEQ ID NO: 490312 - DNA, 15 bp, Homo sapiens
ggtcctgatagcatc

SEQ ID NO: 490313 - DNA, 15 bp, Homo sapiens
gtcctgatagcatcc

SEQ ID NO: 490314 - DNA, 15 bp, Homo sapiens
tcctgatagcatcct

SEQ ID NO: 490315 - DNA, 15 bp, Homo sapiens
cctgatagcatcctt

SEQ ID NO: 490316 - DNA, 15 bp, Homo sapiens
ctgatagcatccttg

SEQ ID NO: 490317 - DNA, 15 bp, Homo sapiens
tgatagcatccttga

SEQ ID NO: 490318 - DNA, 15 bp, Homo sapiens
gatagcatccttgaa

SEQ ID NO: 490319 - DNA, 15 bp, Homo sapiens
atagcatccttgaat

SEQ ID NO: 490320 - DNA, 15 bp, Homo sapiens
tagcatccttgaatt

SEQ ID NO: 490321 - DNA, 15 bp, Homo sapiens
agcatccttgaatta

SEQ ID NO: 490322 - DNA, 15 bp, Homo sapiens
gcatccttgaattat

SEQ ID NO: 490323 - DNA, 15 bp, Homo sapiens
catccttgaattatg

SEQ ID NO: 490324 - DNA, 15 bp, Homo sapiens
atccttgaattatgg

SEQ ID NO: 490325 - DNA, 15 bp, Homo sapiens
tccttgaattatggc

SEQ ID NO: 490326 - DNA, 15 bp, Homo sapiens
ccttgaattatggcc

SEQ ID NO: 490327 - DNA, 15 bp, Homo sapiens
cttgaattatggcct

SEQ ID NO: 490328 - DNA, 15 bp, Homo sapiens
ttgaattatggcctt

SEQ ID NO: 490329 - DNA, 15 bp, Homo sapiens
tgaattatggccttt

SEQ ID NO: 490330 - DNA, 15 bp, Homo sapiens
gaattatggcctttt

SEQ ID NO: 490331 - DNA, 15 bp, Homo sapiens
aattatggcctttta

SEQ ID NO: 490332 - DNA, 15 bp, Homo sapiens
attatggccttttaa

SEQ ID NO: 490333 - DNA, 15 bp, Homo sapiens
ttatggccttttaaa

SEQ ID NO: 490334 - DNA, 15 bp, Homo sapiens
tatggccttttaaag

SEQ ID NO: 490335 - DNA, 15 bp, Homo sapiens
atggccttttaaagt

SEQ ID NO: 490336 - DNA, 15 bp, Homo sapiens
tggccttttaaagtc

SEQ ID NO: 490337 - DNA, 15 bp, Homo sapiens
ggccttttaaagtct

SEQ ID NO: 490338 - DNA, 15 bp, Homo sapiens
gccttttaaagtctt

SEQ ID NO: 490339 - DNA, 15 bp, Homo sapiens
ccttttaaagtcttt

SEQ ID NO: 490340 - DNA, 15 bp, Homo sapiens
cttttaaagtctttt

SEQ ID NO: 490341 - DNA, 15 bp, Homo sapiens
ttttaaagtcttttt

SEQ ID NO: 490342 - DNA, 15 bp, Homo sapiens
tttaaagtcttttta

SEQ ID NO: 490343 - DNA, 15 bp, Homo sapiens
ttaaagtctttttaa

SEQ ID NO: 490344 - DNA, 15 bp, Homo sapiens
taaagtctttttaaa

SEQ ID NO: 490345 - DNA, 15 bp, Homo sapiens
aaagtctttttaaaa

SEQ ID NO: 490346 - DNA, 15 bp, Homo sapiens
aagtctttttaaaat

SEQ ID NO: 490347 - DNA, 15 bp, Homo sapiens
agtctttttaaaatt

SEQ ID NO: 490348 - DNA, 15 bp, Homo sapiens
gtctttttaaaatta

SEQ ID NO: 490349 - DNA, 15 bp, Homo sapiens
tctttttaaaattat

SEQ ID NO: 490350 - DNA, 15 bp, Homo sapiens
ctttttaaaattatt

SEQ ID NO: 490351 - DNA, 15 bp, Homo sapiens
tttttaaaattattt

SEQ ID NO: 490352 - DNA, 15 bp, Homo sapiens
ttttaaaattattta

SEQ ID NO: 490353 - DNA, 15 bp, Homo sapiens
tttaaaattatttat

SEQ ID NO: 490354 - DNA, 15 bp, Homo sapiens
ttaaaattatttatg

SEQ ID NO: 490355 - DNA, 15 bp, Homo sapiens
taaaattatttatgt

SEQ ID NO: 490356 - DNA, 15 bp, Homo sapiens
aaaattatttatgtt

SEQ ID NO: 490357 - DNA, 15 bp, Homo sapiens
aaattatttatgttg

SEQ ID NO: 490358 - DNA, 15 bp, Homo sapiens
aattatttatgttga

SEQ ID NO: 490359 - DNA, 15 bp, Homo sapiens
attatttatgttgag

SEQ ID NO: 490360 - DNA, 15 bp, Homo sapiens
ttatttatgttgagt

SEQ ID NO: 490361 - DNA, 15 bp, Homo sapiens
tatttatgttgagtc

SEQ ID NO: 490362 - DNA, 15 bp, Homo sapiens
atttatgttgagtct

SEQ ID NO: 490363 - DNA, 15 bp, Homo sapiens
tttatgttgagtctt

SEQ ID NO: 490364 - DNA, 15 bp, Homo sapiens
ttatgttgagtctta

SEQ ID NO: 490365 - DNA, 15 bp, Homo sapiens
tatgttgagtcttag

SEQ ID NO: 490366 - DNA, 15 bp, Homo sapiens
atgttgagtcttaga

SEQ ID NO: 490367 - DNA, 15 bp, Homo sapiens
tgttgagtcttagag

SEQ ID NO: 490368 - DNA, 15 bp, Homo sapiens
gttgagtcttagagc

SEQ ID NO: 490369 - DNA, 15 bp, Homo sapiens
ttgagtcttagagca

SEQ ID NO: 490370 - DNA, 15 bp, Homo sapiens
tgagtcttagagcag

SEQ ID NO: 490371 - DNA, 15 bp, Homo sapiens
gagtcttagagcaga

SEQ ID NO: 490372 - DNA, 15 bp, Homo sapiens
agtcttagagcagag

SEQ ID NO: 490373 - DNA, 15 bp, Homo sapiens
gtcttagagcagaga

SEQ ID NO: 490374 - DNA, 15 bp, Homo sapiens
tcttagagcagagaa

SEQ ID NO: 490375 - DNA, 15 bp, Homo sapiens
cttagagcagagaag

SEQ ID NO: 490376 - DNA, 15 bp, Homo sapiens
ttagagcagagaagc

SEQ ID NO: 490377 - DNA, 15 bp, Homo sapiens
tagagcagagaagca

SEQ ID NO: 490378 - DNA, 15 bp, Homo sapiens
agagcagagaagcag

SEQ ID NO: 490379 - DNA, 15 bp, Homo sapiens
gagcagagaagcaga

SEQ ID NO: 490380 - DNA, 15 bp, Homo sapiens
agcagagaagcagac

SEQ ID NO: 490381 - DNA, 15 bp, Homo sapiens
gcagagaagcagaca

SEQ ID NO: 490382 - DNA, 15 bp, Homo sapiens
cagagaagcagacat

SEQ ID NO: 490383 - DNA, 15 bp, Homo sapiens
agagaagcagacatt

SEQ ID NO: 490384 - DNA, 15 bp, Homo sapiens
gagaagcagacattt

SEQ ID NO: 490385 - DNA, 15 bp, Homo sapiens
agaagcagacatttc

SEQ ID NO: 490386 - DNA, 15 bp, Homo sapiens
gaagcagacatttcc

SEQ ID NO: 490387 - DNA, 15 bp, Homo sapiens
aagcagacatttcct

SEQ ID NO: 490388 - DNA, 15 bp, Homo sapiens
agcagacatttcctt

SEQ ID NO: 490389 - DNA, 15 bp, Homo sapiens
gcagacatttccttc

SEQ ID NO: 490390 - DNA, 15 bp, Homo sapiens
cagacatttccttca

SEQ ID NO: 490391 - DNA, 15 bp, Homo sapiens
agacatttccttcac

SEQ ID NO: 490392 - DNA, 15 bp, Homo sapiens
gacatttccttcact

SEQ ID NO: 490393 - DNA, 15 bp, Homo sapiens
acatttccttcactt

SEQ ID NO: 490394 - DNA, 15 bp, Homo sapiens
catttccttcacttc

SEQ ID NO: 490395 - DNA, 15 bp, Homo sapiens
atttccttcacttcc

SEQ ID NO: 490396 - DNA, 15 bp, Homo sapiens
tttccttcacttcct

SEQ ID NO: 490397 - DNA, 15 bp, Homo sapiens
ttccttcacttcctg

SEQ ID NO: 490398 - DNA, 15 bp, Homo sapiens
tccttcacttcctgg

SEQ ID NO: 490399 - DNA, 15 bp, Homo sapiens
ccttcacttcctggc

SEQ ID NO: 490400 - DNA, 15 bp, Homo sapiens
cttcacttcctggca

SEQ ID NO: 490401 - DNA, 15 bp, Homo sapiens
ttcacttcctggcaa

SEQ ID NO: 490402 - DNA, 15 bp, Homo sapiens
tcacttcctggcaag

SEQ ID NO: 490403 - DNA, 15 bp, Homo sapiens
cacttcctggcaagg

SEQ ID NO: 490404 - DNA, 15 bp, Homo sapiens
acttcctggcaagga

SEQ ID NO: 490405 - DNA, 15 bp, Homo sapiens
cttcctggcaaggag

SEQ ID NO: 490406 - DNA, 15 bp, Homo sapiens
ttcctggcaaggagt

SEQ ID NO: 490407 - DNA, 15 bp, Homo sapiens
tcctggcaaggagtt

SEQ ID NO: 490408 - DNA, 15 bp, Homo sapiens
cctggcaaggagtta

SEQ ID NO: 490409 - DNA, 15 bp, Homo sapiens
ctggcaaggagttaa

SEQ ID NO: 490410 - DNA, 15 bp, Homo sapiens
tggcaaggagttaag

SEQ ID NO: 490411 - DNA, 15 bp, Homo sapiens
ggcaaggagttaagg

SEQ ID NO: 490412 - DNA, 15 bp, Homo sapiens
gcaaggagttaagga

SEQ ID NO: 490413 - DNA, 15 bp, Homo sapiens
caaggagttaaggaa

SEQ ID NO: 490414 - DNA, 15 bp, Homo sapiens
aaggagttaaggaaa

SEQ ID NO: 490415 - DNA, 15 bp, Homo sapiens
aggagttaaggaaag

SEQ ID NO: 490416 - DNA, 15 bp, Homo sapiens
ggagttaaggaaagg

SEQ ID NO: 490417 - DNA, 15 bp, Homo sapiens
gagttaaggaaaggg

SEQ ID NO: 490418 - DNA, 15 bp, Homo sapiens
agttaaggaaagggg

SEQ ID NO: 490419 - DNA, 15 bp, Homo sapiens
gttaaggaaaggggt

SEQ ID NO: 490420 - DNA, 15 bp, Homo sapiens
ttaaggaaaggggtt

SEQ ID NO: 490421 - DNA, 15 bp, Homo sapiens
taaggaaaggggttt

SEQ ID NO: 490422 - DNA, 15 bp, Homo sapiens
aaggaaaggggttta

SEQ ID NO: 490423 - DNA, 15 bp, Homo sapiens
aggaaaggggtttaa

SEQ ID NO: 490424 - DNA, 15 bp, Homo sapiens
ggaaaggggtttaaa

SEQ ID NO: 490425 - DNA, 15 bp, Homo sapiens
gaaaggggtttaaat

SEQ ID NO: 490426 - DNA, 15 bp, Homo sapiens
aaaggggtttaaatg

SEQ ID NO: 490427 - DNA, 15 bp, Homo sapiens
aaggggtttaaatgt

SEQ ID NO: 490428 - DNA, 15 bp, Homo sapiens
aggggtttaaatgta

SEQ ID NO: 490429 - DNA, 15 bp, Homo sapiens
ggggtttaaatgtac

SEQ ID NO: 490430 - DNA, 15 bp, Homo sapiens
gggtttaaatgtact

SEQ ID NO: 490431 - DNA, 15 bp, Homo sapiens
ggtttaaatgtactg

SEQ ID NO: 490432 - DNA, 15 bp, Homo sapiens
gtttaaatgtactgc

SEQ ID NO: 490433 - DNA, 15 bp, Homo sapiens
tttaaatgtactgcc

SEQ ID NO: 490434 - DNA, 15 bp, Homo sapiens
ttaaatgtactgcca

SEQ ID NO: 490435 - DNA, 15 bp, Homo sapiens
taaatgtactgccaa

SEQ ID NO: 490436 - DNA, 15 bp, Homo sapiens
aaatgtactgccaat

SEQ ID NO: 490437 - DNA, 15 bp, Homo sapiens
aatgtactgccaatt

SEQ ID NO: 490438 - DNA, 15 bp, Homo sapiens
atgtactgccaatta

SEQ ID NO: 490439 - DNA, 15 bp, Homo sapiens
tgtactgccaattaa

SEQ ID NO: 490440 - DNA, 15 bp, Homo sapiens
gtactgccaattaac

SEQ ID NO: 490441 - DNA, 15 bp, Homo sapiens
tactgccaattaaca

SEQ ID NO: 490442 - DNA, 15 bp, Homo sapiens
actgccaattaacaa

SEQ ID NO: 490443 - DNA, 15 bp, Homo sapiens
ctgccaattaacaag

SEQ ID NO: 490444 - DNA, 15 bp, Homo sapiens
tgccaattaacaagt

SEQ ID NO: 490445 - DNA, 15 bp, Homo sapiens
gccaattaacaagtg

SEQ ID NO: 490446 - DNA, 15 bp, Homo sapiens
ccaattaacaagtgt

SEQ ID NO: 490447 - DNA, 15 bp, Homo sapiens
caattaacaagtgta

SEQ ID NO: 490448 - DNA, 15 bp, Homo sapiens
aattaacaagtgtac

SEQ ID NO: 490449 - DNA, 15 bp, Homo sapiens
attaacaagtgtact

SEQ ID NO: 490450 - DNA, 15 bp, Homo sapiens
ttaacaagtgtactt

SEQ ID NO: 490451 - DNA, 15 bp, Homo sapiens
taacaagtgtactta

SEQ ID NO: 490452 - DNA, 15 bp, Homo sapiens
aacaagtgtacttac

SEQ ID NO: 490453 - DNA, 15 bp, Homo sapiens
acaagtgtacttact

SEQ ID NO: 490454 - DNA, 15 bp, Homo sapiens
caagtgtacttacta

SEQ ID NO: 490455 - DNA, 15 bp, Homo sapiens
aagtgtacttactaa

SEQ ID NO: 490456 - DNA, 15 bp, Homo sapiens
agtgtacttactaaa

SEQ ID NO: 490457 - DNA, 15 bp, Homo sapiens
gtgtacttactaaaa

SEQ ID NO: 490458 - DNA, 15 bp, Homo sapiens
tgtacttactaaaat

SEQ ID NO: 490459 - DNA, 15 bp, Homo sapiens
gtacttactaaaatt

SEQ ID NO: 490460 - DNA, 15 bp, Homo sapiens
tacttactaaaattc

SEQ ID NO: 490461 - DNA, 15 bp, Homo sapiens
acttactaaaattcc

SEQ ID NO: 490462 - DNA, 15 bp, Homo sapiens
cttactaaaattccc

SEQ ID NO: 490463 - DNA, 15 bp, Homo sapiens
ttactaaaattccca

SEQ ID NO: 490464 - DNA, 15 bp, Homo sapiens
tactaaaattcccac

SEQ ID NO: 490465 - DNA, 15 bp, Homo sapiens
actaaaattcccact

SEQ ID NO: 490466 - DNA, 15 bp, Homo sapiens
ctaaaattcccactg

SEQ ID NO: 490467 - DNA, 15 bp, Homo sapiens
taaaattcccactga

SEQ ID NO: 490468 - DNA, 15 bp, Homo sapiens
aaaattcccactgac

SEQ ID NO: 490469 - DNA, 15 bp, Homo sapiens
aaattcccactgact

SEQ ID NO: 490470 - DNA, 15 bp, Homo sapiens
aattcccactgactg

SEQ ID NO: 490471 - DNA, 15 bp, Homo sapiens
attcccactgactgc

SEQ ID NO: 490472 - DNA, 15 bp, Homo sapiens
ttcccactgactgca

SEQ ID NO: 490473 - DNA, 15 bp, Homo sapiens
tcccactgactgcag

SEQ ID NO: 490474 - DNA, 15 bp, Homo sapiens
cccactgactgcagt

SEQ ID NO: 490475 - DNA, 15 bp, Homo sapiens
ccactgactgcagta

SEQ ID NO: 490476 - DNA, 15 bp, Homo sapiens
cactgactgcagtaa

SEQ ID NO: 490477 - DNA, 15 bp, Homo sapiens
actgactgcagtaac

SEQ ID NO: 490478 - DNA, 15 bp, Homo sapiens
ctgactgcagtaact

SEQ ID NO: 490479 - DNA, 15 bp, Homo sapiens
tgactgcagtaacta

SEQ ID NO: 490480 - DNA, 15 bp, Homo sapiens
gactgcagtaactat

SEQ ID NO: 490481 - DNA, 15 bp, Homo sapiens
actgcagtaactatt

SEQ ID NO: 490482 - DNA, 15 bp, Homo sapiens
ctgcagtaactattt

SEQ ID NO: 490483 - DNA, 15 bp, Homo sapiens
tgcagtaactatttt

SEQ ID NO: 490484 - DNA, 15 bp, Homo sapiens
gcagtaactattttt

SEQ ID NO: 490485 - DNA, 15 bp, Homo sapiens
cagtaactattttta

SEQ ID NO: 490486 - DNA, 15 bp, Homo sapiens
agtaactatttttat

SEQ ID NO: 490487 - DNA, 15 bp, Homo sapiens
gtaactatttttatt

SEQ ID NO: 490488 - DNA, 15 bp, Homo sapiens
taactatttttattt

SEQ ID NO: 490489 - DNA, 15 bp, Homo sapiens
aactatttttatttt

SEQ ID NO: 490490 - DNA, 15 bp, Homo sapiens
actatttttattttt

SEQ ID NO: 490491 - DNA, 15 bp, Homo sapiens
ctatttttatttttt

SEQ ID NO: 490492 - DNA, 15 bp, Homo sapiens
atttttattttttgg

SEQ ID NO: 490493 - DNA, 15 bp, Homo sapiens
tttttattttttggt

SEQ ID NO: 490494 - DNA, 15 bp, Homo sapiens
tttattttttggtat

SEQ ID NO: 490495 - DNA, 15 bp, Homo sapiens
ttattttttggtata

SEQ ID NO: 490496 - DNA, 15 bp, Homo sapiens
tattttttggtataa

SEQ ID NO: 490497 - DNA, 15 bp, Homo sapiens
attttttggtataaa

SEQ ID NO: 490498 - DNA, 15 bp, Homo sapiens
ttttttggtataaat

SEQ ID NO: 490499 - DNA, 15 bp, Homo sapiens
tttttggtataaatt

SEQ ID NO: 490500 - DNA, 15 bp, Homo sapiens
ttttggtataaattt

SEQ ID NO: 490501 - DNA, 15 bp, Homo sapiens
tttggtataaatttt

SEQ ID NO: 490502 - DNA, 15 bp, Homo sapiens
ttggtataaattttt

SEQ ID NO: 490503 - DNA, 15 bp, Homo sapiens
tggtataaatttttt

SEQ ID NO: 490504 - DNA, 15 bp, Homo sapiens
ggtataaattttttt

SEQ ID NO: 490505 - DNA, 15 bp, Homo sapiens
gtataaatttttttt

SEQ ID NO: 490506 - DNA, 15 bp, Homo sapiens
tataaattttttttg

SEQ ID NO: 490507 - DNA, 15 bp, Homo sapiens
ataaattttttttgt

SEQ ID NO: 490508 - DNA, 15 bp, Homo sapiens
taaattttttttgtc

SEQ ID NO: 490509 - DNA, 15 bp, Homo sapiens
aaattttttttgtcc

SEQ ID NO: 490510 - DNA, 15 bp, Homo sapiens
aattttttttgtcca

SEQ ID NO: 490511 - DNA, 15 bp, Homo sapiens
attttttttgtccat

SEQ ID NO: 490512 - DNA, 15 bp, Homo sapiens
ttttttttgtccatt

SEQ ID NO: 490513 - DNA, 15 bp, Homo sapiens
tttttttgtccattt

SEQ ID NO: 490514 - DNA, 15 bp, Homo sapiens
ttttttgtccatttt

SEQ ID NO: 490515 - DNA, 15 bp, Homo sapiens
tttttgtccattttt

SEQ ID NO: 490516 - DNA, 15 bp, Homo sapiens
ttttgtccatttttt

SEQ ID NO: 490517 - DNA, 15 bp, Homo sapiens
tttgtccatttttta

SEQ ID NO: 490518 - DNA, 15 bp, Homo sapiens
ttgtccattttttac

SEQ ID NO: 490519 - DNA, 15 bp, Homo sapiens
tgtccattttttact

SEQ ID NO: 490520 - DNA, 15 bp, Homo sapiens
gtccattttttactt

SEQ ID NO: 490521 - DNA, 15 bp, Homo sapiens
tccattttttactta

SEQ ID NO: 490522 - DNA, 15 bp, Homo sapiens
ccattttttacttat

SEQ ID NO: 490523 - DNA, 15 bp, Homo sapiens
cattttttacttatg

SEQ ID NO: 490524 - DNA, 15 bp, Homo sapiens
attttttacttatgt

SEQ ID NO: 490525 - DNA, 15 bp, Homo sapiens
ttttttacttatgtc

SEQ ID NO: 490526 - DNA, 15 bp, Homo sapiens
tttttacttatgtcc

SEQ ID NO: 490527 - DNA, 15 bp, Homo sapiens
ttttacttatgtcct

SEQ ID NO: 490528 - DNA, 15 bp, Homo sapiens
tttacttatgtcctt

SEQ ID NO: 490529 - DNA, 15 bp, Homo sapiens
ttacttatgtccttc

SEQ ID NO: 490530 - DNA, 15 bp, Homo sapiens
tacttatgtccttca

SEQ ID NO: 490531 - DNA, 15 bp, Homo sapiens
acttatgtccttcaa

SEQ ID NO: 490532 - DNA, 15 bp, Homo sapiens
cttatgtccttcaaa

SEQ ID NO: 490533 - DNA, 15 bp, Homo sapiens
ttatgtccttcaaat

SEQ ID NO: 490534 - DNA, 15 bp, Homo sapiens
tatgtccttcaaatg

SEQ ID NO: 490535 - DNA, 15 bp, Homo sapiens
atgtccttcaaatgt

SEQ ID NO: 490536 - DNA, 15 bp, Homo sapiens
tgtccttcaaatgta

SEQ ID NO: 490537 - DNA, 15 bp, Homo sapiens
gtccttcaaatgtat

SEQ ID NO: 490538 - DNA, 15 bp, Homo sapiens
tccttcaaatgtatg

SEQ ID NO: 490539 - DNA, 15 bp, Homo sapiens
ccttcaaatgtatga

SEQ ID NO: 490540 - DNA, 15 bp, Homo sapiens
cttcaaatgtatgaa

SEQ ID NO: 490541 - DNA, 15 bp, Homo sapiens
ttcaaatgtatgaaa

SEQ ID NO: 490542 - DNA, 15 bp, Homo sapiens
tcaaatgtatgaaat

SEQ ID NO: 490543 - DNA, 15 bp, Homo sapiens
caaatgtatgaaata

SEQ ID NO: 490544 - DNA, 15 bp, Homo sapiens
aaatgtatgaaatac

SEQ ID NO: 490545 - DNA, 15 bp, Homo sapiens
aatgtatgaaatact

SEQ ID NO: 490546 - DNA, 15 bp, Homo sapiens
atgtatgaaatactg

SEQ ID NO: 490547 - DNA, 15 bp, Homo sapiens
tgtatgaaatactgg

SEQ ID NO: 490548 - DNA, 15 bp, Homo sapiens
gtatgaaatactggc

SEQ ID NO: 490549 - DNA, 15 bp, Homo sapiens
tatgaaatactggca

SEQ ID NO: 490550 - DNA, 15 bp, Homo sapiens
atgaaatactggcag

SEQ ID NO: 490551 - DNA, 15 bp, Homo sapiens
tgaaatactggcagt

SEQ ID NO: 490552 - DNA, 15 bp, Homo sapiens
gaaatactggcagta

SEQ ID NO: 490553 - DNA, 15 bp, Homo sapiens
aaatactggcagtaa

SEQ ID NO: 490554 - DNA, 15 bp, Homo sapiens
aatactggcagtaag

SEQ ID NO: 490555 - DNA, 15 bp, Homo sapiens
atactggcagtaagc

SEQ ID NO: 490556 - DNA, 15 bp, Homo sapiens
tactggcagtaagcc

SEQ ID NO: 490557 - DNA, 15 bp, Homo sapiens
actggcagtaagcca

SEQ ID NO: 490558 - DNA, 15 bp, Homo sapiens
ctggcagtaagccaa

SEQ ID NO: 490559 - DNA, 15 bp, Homo sapiens
tggcagtaagccaac

SEQ ID NO: 490560 - DNA, 15 bp, Homo sapiens
ggcagtaagccaact

SEQ ID NO: 490561 - DNA, 15 bp, Homo sapiens
gcagtaagccaacta

SEQ ID NO: 490562 - DNA, 15 bp, Homo sapiens
cagtaagccaactaa

SEQ ID NO: 490563 - DNA, 15 bp, Homo sapiens
agtaagccaactaat

SEQ ID NO: 490564 - DNA, 15 bp, Homo sapiens
gtaagccaactaatt

SEQ ID NO: 490565 - DNA, 15 bp, Homo sapiens
taagccaactaattt

SEQ ID NO: 490566 - DNA, 15 bp, Homo sapiens
aagccaactaatttt

SEQ ID NO: 490567 - DNA, 15 bp, Homo sapiens
agccaactaattttt

SEQ ID NO: 490568 - DNA, 15 bp, Homo sapiens
gccaactaatttttg

SEQ ID NO: 490569 - DNA, 15 bp, Homo sapiens
ccaactaatttttgc

SEQ ID NO: 490570 - DNA, 15 bp, Homo sapiens
caactaatttttgct

SEQ ID NO: 490571 - DNA, 15 bp, Homo sapiens
aactaatttttgctg

SEQ ID NO: 490572 - DNA, 15 bp, Homo sapiens
actaatttttgctga

SEQ ID NO: 490573 - DNA, 15 bp, Homo sapiens
ctaatttttgctgat

SEQ ID NO: 490574 - DNA, 15 bp, Homo sapiens
taatttttgctgata

SEQ ID NO: 490575 - DNA, 15 bp, Homo sapiens
aatttttgctgatag

SEQ ID NO: 490576 - DNA, 15 bp, Homo sapiens
atttttgctgataga

SEQ ID NO: 490577 - DNA, 15 bp, Homo sapiens
tttttgctgatagac

SEQ ID NO: 490578 - DNA, 15 bp, Homo sapiens
ttttgctgatagacc

SEQ ID NO: 490579 - DNA, 15 bp, Homo sapiens
tttgctgatagacca

SEQ ID NO: 490580 - DNA, 15 bp, Homo sapiens
ttgctgatagaccaa

SEQ ID NO: 490581 - DNA, 15 bp, Homo sapiens
tgctgatagaccaag

SEQ ID NO: 490582 - DNA, 15 bp, Homo sapiens
gctgatagaccaaga

SEQ ID NO: 490583 - DNA, 15 bp, Homo sapiens
ctgatagaccaagaa

SEQ ID NO: 490584 - DNA, 15 bp, Homo sapiens
tgatagaccaagaaa

SEQ ID NO: 490585 - DNA, 15 bp, Homo sapiens
gatagaccaagaaat

SEQ ID NO: 490586 - DNA, 15 bp, Homo sapiens
atagaccaagaaatg

SEQ ID NO: 490587 - DNA, 15 bp, Homo sapiens
tagaccaagaaatgc

SEQ ID NO: 490588 - DNA, 15 bp, Homo sapiens
agaccaagaaatgct

SEQ ID NO: 490589 - DNA, 15 bp, Homo sapiens
gaccaagaaatgctt

SEQ ID NO: 490590 - DNA, 15 bp, Homo sapiens
accaagaaatgcttt

SEQ ID NO: 490591 - DNA, 15 bp, Homo sapiens
ccaagaaatgctttc

SEQ ID NO: 490592 - DNA, 15 bp, Homo sapiens
caagaaatgctttca

SEQ ID NO: 490593 - DNA, 15 bp, Homo sapiens
aagaaatgctttcaa

SEQ ID NO: 490594 - DNA, 15 bp, Homo sapiens
agaaatgctttcaaa

SEQ ID NO: 490595 - DNA, 15 bp, Homo sapiens
gaaatgctttcaaaa

SEQ ID NO: 490596 - DNA, 15 bp, Homo sapiens
aaatgctttcaaaat

SEQ ID NO: 490597 - DNA, 15 bp, Homo sapiens
aatgctttcaaaatt

SEQ ID NO: 490598 - DNA, 15 bp, Homo sapiens
atgctttcaaaatta

SEQ ID NO: 490599 - DNA, 15 bp, Homo sapiens
tgctttcaaaattat

SEQ ID NO: 490600 - DNA, 15 bp, Homo sapiens
gctttcaaaattatt

SEQ ID NO: 490601 - DNA, 15 bp, Homo sapiens
ctttcaaaattattt

SEQ ID NO: 490602 - DNA, 15 bp, Homo sapiens
tttcaaaattatttt

SEQ ID NO: 490603 - DNA, 15 bp, Homo sapiens
ttcaaaattattttt

SEQ ID NO: 490604 - DNA, 15 bp, Homo sapiens
tcaaaattatttttg

SEQ ID NO: 490605 - DNA, 15 bp, Homo sapiens
caaaattatttttga

SEQ ID NO: 490606 - DNA, 15 bp, Homo sapiens
aaaattatttttgac

SEQ ID NO: 490607 - DNA, 15 bp, Homo sapiens
aaattatttttgacc

SEQ ID NO: 490608 - DNA, 15 bp, Homo sapiens
aattatttttgaccc

SEQ ID NO: 490609 - DNA, 15 bp, Homo sapiens
attatttttgaccca

SEQ ID NO: 490610 - DNA, 15 bp, Homo sapiens
ttatttttgacccac

SEQ ID NO: 490611 - DNA, 15 bp, Homo sapiens
tatttttgacccaca

SEQ ID NO: 490612 - DNA, 15 bp, Homo sapiens
atttttgacccacag

SEQ ID NO: 490613 - DNA, 15 bp, Homo sapiens
tttttgacccacagg

SEQ ID NO: 490614 - DNA, 15 bp, Homo sapiens
ttttgacccacaggc

SEQ ID NO: 490615 - DNA, 15 bp, Homo sapiens
tttgacccacaggca

SEQ ID NO: 490616 - DNA, 15 bp, Homo sapiens
ttgacccacaggcat

SEQ ID NO: 490617 - DNA, 15 bp, Homo sapiens
tgacccacaggcata

SEQ ID NO: 490618 - DNA, 15 bp, Homo sapiens
gacccacaggcatat

SEQ ID NO: 490619 - DNA, 15 bp, Homo sapiens
acccacaggcatatt

SEQ ID NO: 490620 - DNA, 15 bp, Homo sapiens
cccacaggcatattt

SEQ ID NO: 490621 - DNA, 15 bp, Homo sapiens
ccacaggcatatttt

SEQ ID NO: 490622 - DNA, 15 bp, Homo sapiens
cacaggcatattttt

SEQ ID NO: 490623 - DNA, 15 bp, Homo sapiens
acaggcatattttta

SEQ ID NO: 490624 - DNA, 15 bp, Homo sapiens
caggcatatttttac

SEQ ID NO: 490625 - DNA, 15 bp, Homo sapiens
aggcatatttttact

SEQ ID NO: 490626 - DNA, 15 bp, Homo sapiens
ggcatatttttacta

SEQ ID NO: 490627 - DNA, 15 bp, Homo sapiens
gcatatttttactat

SEQ ID NO: 490628 - DNA, 15 bp, Homo sapiens
catatttttactatg

SEQ ID NO: 490629 - DNA, 15 bp, Homo sapiens
atatttttactatga

SEQ ID NO: 490630 - DNA, 15 bp, Homo sapiens
tatttttactatgaa

SEQ ID NO: 490631 - DNA, 15 bp, Homo sapiens
atttttactatgaat

SEQ ID NO: 490632 - DNA, 15 bp, Homo sapiens
tttttactatgaatt

SEQ ID NO: 490633 - DNA, 15 bp, Homo sapiens
ttttactatgaattg

SEQ ID NO: 490634 - DNA, 15 bp, Homo sapiens
tttactatgaattgc

SEQ ID NO: 490635 - DNA, 15 bp, Homo sapiens
ttactatgaattgcc

SEQ ID NO: 490636 - DNA, 15 bp, Homo sapiens
tactatgaattgcct

SEQ ID NO: 490637 - DNA, 15 bp, Homo sapiens
actatgaattgccta

SEQ ID NO: 490638 - DNA, 15 bp, Homo sapiens
ctatgaattgcctat

SEQ ID NO: 490639 - DNA, 15 bp, Homo sapiens
tatgaattgcctatg

SEQ ID NO: 490640 - DNA, 15 bp, Homo sapiens
atgaattgcctatgt

SEQ ID NO: 490641 - DNA, 15 bp, Homo sapiens
tgaattgcctatgtt

SEQ ID NO: 490642 - DNA, 15 bp, Homo sapiens
gaattgcctatgttt

SEQ ID NO: 490643 - DNA, 15 bp, Homo sapiens
aattgcctatgttta

SEQ ID NO: 490644 - DNA, 15 bp, Homo sapiens
attgcctatgtttat

SEQ ID NO: 490645 - DNA, 15 bp, Homo sapiens
ttgcctatgtttatt

SEQ ID NO: 490646 - DNA, 15 bp, Homo sapiens
tgcctatgtttatta

SEQ ID NO: 490647 - DNA, 15 bp, Homo sapiens
gcctatgtttattaa

SEQ ID NO: 490648 - DNA, 15 bp, Homo sapiens
cctatgtttattaag

SEQ ID NO: 490649 - DNA, 15 bp, Homo sapiens
ctatgtttattaagc

SEQ ID NO: 490650 - DNA, 15 bp, Homo sapiens
tatgtttattaagct

SEQ ID NO: 490651 - DNA, 15 bp, Homo sapiens
tttattaagcttgaa

SEQ ID NO: 490652 - DNA, 15 bp, Homo sapiens
ttattaagcttgaat

SEQ ID NO: 490653 - DNA, 15 bp, Homo sapiens
tattaagcttgaatg

SEQ ID NO: 490654 - DNA, 15 bp, Homo sapiens
attaagcttgaatgg

SEQ ID NO: 490655 - DNA, 15 bp, Homo sapiens
ttaagcttgaatggc

SEQ ID NO: 490656 - DNA, 15 bp, Homo sapiens
taagcttgaatggca

SEQ ID NO: 490657 - DNA, 15 bp, Homo sapiens
aagcttgaatggcat

SEQ ID NO: 490658 - DNA, 15 bp, Homo sapiens
agcttgaatggcatt

SEQ ID NO: 490659 - DNA, 15 bp, Homo sapiens
gcttgaatggcattc

SEQ ID NO: 490660 - DNA, 15 bp, Homo sapiens
cttgaatggcattca

SEQ ID NO: 490661 - DNA, 15 bp, Homo sapiens
ttgaatggcattcat

SEQ ID NO: 490662 - DNA, 15 bp, Homo sapiens
tgaatggcattcatc

SEQ ID NO: 490663 - DNA, 15 bp, Homo sapiens
gaatggcattcatca

SEQ ID NO: 490664 - DNA, 15 bp, Homo sapiens
aatggcattcatcaa

SEQ ID NO: 490665 - DNA, 15 bp, Homo sapiens
atggcattcatcaaa

SEQ ID NO: 490666 - DNA, 15 bp, Homo sapiens
tggcattcatcaaaa

SEQ ID NO: 490667 - DNA, 15 bp, Homo sapiens
ggcattcatcaaaaa

SEQ ID NO: 490668 - DNA, 15 bp, Homo sapiens
gcattcatcaaaaac

SEQ ID NO: 490669 - DNA, 15 bp, Homo sapiens
cattcatcaaaaacc

SEQ ID NO: 490670 - DNA, 15 bp, Homo sapiens
attcatcaaaaaccc

SEQ ID NO: 490671 - DNA, 15 bp, Homo sapiens
ttcatcaaaaaccca

SEQ ID NO: 490672 - DNA, 15 bp, Homo sapiens
tcatcaaaaacccaa

SEQ ID NO: 490673 - DNA, 15 bp, Homo sapiens
catcaaaaacccaaa

SEQ ID NO: 490674 - DNA, 15 bp, Homo sapiens
atcaaaaacccaaaa

SEQ ID NO: 490675 - DNA, 15 bp, Homo sapiens
tcaaaaacccaaaac

SEQ ID NO: 490676 - DNA, 15 bp, Homo sapiens
caaaaacccaaaacc

SEQ ID NO: 490677 - DNA, 15 bp, Homo sapiens
aaaaacccaaaaccc

SEQ ID NO: 490678 - DNA, 15 bp, Homo sapiens
aaaacccaaaaccca

SEQ ID NO: 490679 - DNA, 15 bp, Homo sapiens
aaacccaaaacccac

SEQ ID NO: 490680 - DNA, 15 bp, Homo sapiens
aacccaaaacccact

SEQ ID NO: 490681 - DNA, 15 bp, Homo sapiens
acccaaaacccactg

SEQ ID NO: 490682 - DNA, 15 bp, Homo sapiens
cccaaaacccactgc

SEQ ID NO: 490683 - DNA, 15 bp, Homo sapiens
ccaaaacccactgca

SEQ ID NO: 490684 - DNA, 15 bp, Homo sapiens
caaaacccactgcaa

SEQ ID NO: 490685 - DNA, 15 bp, Homo sapiens
aaaacccactgcaat

SEQ ID NO: 490686 - DNA, 15 bp, Homo sapiens
aaacccactgcaatg

SEQ ID NO: 490687 - DNA, 15 bp, Homo sapiens
aacccactgcaatgc

SEQ ID NO: 490688 - DNA, 15 bp, Homo sapiens
acccactgcaatgca

SEQ ID NO: 490689 - DNA, 15 bp, Homo sapiens
cccactgcaatgcag

SEQ ID NO: 490690 - DNA, 15 bp, Homo sapiens
ccactgcaatgcagt

SEQ ID NO: 490691 - DNA, 15 bp, Homo sapiens
cactgcaatgcagtg

SEQ ID NO: 490692 - DNA, 15 bp, Homo sapiens
actgcaatgcagtga

SEQ ID NO: 490693 - DNA, 15 bp, Homo sapiens
ctgcaatgcagtgat

SEQ ID NO: 490694 - DNA, 15 bp, Homo sapiens
tgcaatgcagtgatt

SEQ ID NO: 490695 - DNA, 15 bp, Homo sapiens
gcaatgcagtgattt

SEQ ID NO: 490696 - DNA, 15 bp, Homo sapiens
caatgcagtgatttc

SEQ ID NO: 490697 - DNA, 15 bp, Homo sapiens
aatgcagtgatttcc

SEQ ID NO: 490698 - DNA, 15 bp, Homo sapiens
atgcagtgatttcct

SEQ ID NO: 490699 - DNA, 15 bp, Homo sapiens
tgcagtgatttcctt

SEQ ID NO: 490700 - DNA, 15 bp, Homo sapiens
gcagtgatttccttt

SEQ ID NO: 490701 - DNA, 15 bp, Homo sapiens
cagtgatttcctttt

SEQ ID NO: 490702 - DNA, 15 bp, Homo sapiens
agtgatttccttttt

SEQ ID NO: 490703 - DNA, 15 bp, Homo sapiens
gtgatttccttttta

SEQ ID NO: 490704 - DNA, 15 bp, Homo sapiens
tgatttcctttttaa

SEQ ID NO: 490705 - DNA, 15 bp, Homo sapiens
gatttcctttttaaa

SEQ ID NO: 490706 - DNA, 15 bp, Homo sapiens
atttcctttttaaaa

SEQ ID NO: 490707 - DNA, 15 bp, Homo sapiens
tttcctttttaaaat

SEQ ID NO: 490708 - DNA, 15 bp, Homo sapiens
ttcctttttaaaata

SEQ ID NO: 490709 - DNA, 15 bp, Homo sapiens
tcctttttaaaatat

SEQ ID NO: 490710 - DNA, 15 bp, Homo sapiens
cctttttaaaatatt

SEQ ID NO: 490711 - DNA, 15 bp, Homo sapiens
ctttttaaaatattt

SEQ ID NO: 490712 - DNA, 15 bp, Homo sapiens
tttttaaaatatttt

SEQ ID NO: 490713 - DNA, 15 bp, Homo sapiens
ttttaaaatattttt

SEQ ID NO: 490714 - DNA, 15 bp, Homo sapiens
tttaaaatatttttg

SEQ ID NO: 490715 - DNA, 15 bp, Homo sapiens
ttaaaatatttttgt

SEQ ID NO: 490716 - DNA, 15 bp, Homo sapiens
taaaatatttttgtg

SEQ ID NO: 490717 - DNA, 15 bp, Homo sapiens
aaaatatttttgtgt

SEQ ID NO: 490718 - DNA, 15 bp, Homo sapiens
aaatatttttgtgtg

SEQ ID NO: 490719 - DNA, 15 bp, Homo sapiens
aatatttttgtgtga

SEQ ID NO: 490720 - DNA, 15 bp, Homo sapiens
atatttttgtgtgat

SEQ ID NO: 490721 - DNA, 15 bp, Homo sapiens
tatttttgtgtgatt

SEQ ID NO: 490722 - DNA, 15 bp, Homo sapiens
atttttgtgtgattt

SEQ ID NO: 490723 - DNA, 15 bp, Homo sapiens
tttttgtgtgatttg

SEQ ID NO: 490724 - DNA, 15 bp, Homo sapiens
ttttgtgtgatttgt

SEQ ID NO: 490725 - DNA, 15 bp, Homo sapiens
tttgtgtgatttgtt

SEQ ID NO: 490726 - DNA, 15 bp, Homo sapiens
ttgtgtgatttgttc

SEQ ID NO: 490727 - DNA, 15 bp, Homo sapiens
tgtgtgatttgttca

SEQ ID NO: 490728 - DNA, 15 bp, Homo sapiens
gtgtgatttgttcag

SEQ ID NO: 490729 - DNA, 15 bp, Homo sapiens
tgtgatttgttcagg

SEQ ID NO: 490730 - DNA, 15 bp, Homo sapiens
gtgatttgttcaggc

SEQ ID NO: 490731 - DNA, 15 bp, Homo sapiens
tgatttgttcaggca

SEQ ID NO: 490732 - DNA, 15 bp, Homo sapiens
gatttgttcaggcaa

SEQ ID NO: 490733 - DNA, 15 bp, Homo sapiens
atttgttcaggcaaa

SEQ ID NO: 490734 - DNA, 15 bp, Homo sapiens
tttgttcaggcaaat

SEQ ID NO: 490735 - DNA, 15 bp, Homo sapiens
ttgttcaggcaaata

SEQ ID NO: 490736 - DNA, 15 bp, Homo sapiens
tgttcaggcaaatac

SEQ ID NO: 490737 - DNA, 15 bp, Homo sapiens
gttcaggcaaatacc

SEQ ID NO: 490738 - DNA, 15 bp, Homo sapiens
ttcaggcaaataccc

SEQ ID NO: 490739 - DNA, 15 bp, Homo sapiens
tcaggcaaataccca

SEQ ID NO: 490740 - DNA, 15 bp, Homo sapiens
caggcaaatacccat

SEQ ID NO: 490741 - DNA, 15 bp, Homo sapiens
aggcaaatacccata

SEQ ID NO: 490742 - DNA, 15 bp, Homo sapiens
ggcaaatacccatag

SEQ ID NO: 490743 - DNA, 15 bp, Homo sapiens
gcaaatacccatagc

SEQ ID NO: 490744 - DNA, 15 bp, Homo sapiens
caaatacccatagcc

SEQ ID NO: 490745 - DNA, 15 bp, Homo sapiens
aaatacccatagcct

SEQ ID NO: 490746 - DNA, 15 bp, Homo sapiens
aatacccatagcctt

SEQ ID NO: 490747 - DNA, 15 bp, Homo sapiens
atacccatagccttt

SEQ ID NO: 490748 - DNA, 15 bp, Homo sapiens
tacccatagcctttt

SEQ ID NO: 490749 - DNA, 15 bp, Homo sapiens
acccatagcctttta

SEQ ID NO: 490750 - DNA, 15 bp, Homo sapiens
cccatagccttttat

SEQ ID NO: 490751 - DNA, 15 bp, Homo sapiens
ccatagccttttatt

SEQ ID NO: 490752 - DNA, 15 bp, Homo sapiens
catagccttttattt

SEQ ID NO: 490753 - DNA, 15 bp, Homo sapiens
atagccttttatttg

SEQ ID NO: 490754 - DNA, 15 bp, Homo sapiens
tagccttttatttga

SEQ ID NO: 490755 - DNA, 15 bp, Homo sapiens
agccttttatttgat

SEQ ID NO: 490756 - DNA, 15 bp, Homo sapiens
gccttttatttgata

SEQ ID NO: 490757 - DNA, 15 bp, Homo sapiens
ccttttatttgataa

SEQ ID NO: 490758 - DNA, 15 bp, Homo sapiens
cttttatttgataaa

SEQ ID NO: 490759 - DNA, 15 bp, Homo sapiens
ttttatttgataaaa

SEQ ID NO: 490760 - DNA, 15 bp, Homo sapiens
ttatttgataaaagg

SEQ ID NO: 490761 - DNA, 15 bp, Homo sapiens
tatttgataaaaggc

SEQ ID NO: 490762 - DNA, 15 bp, Homo sapiens
atttgataaaaggct

SEQ ID NO: 490763 - DNA, 15 bp, Homo sapiens
tttgataaaaggctg

SEQ ID NO: 490764 - DNA, 15 bp, Homo sapiens
ttgataaaaggctgt

SEQ ID NO: 490765 - DNA, 15 bp, Homo sapiens
tgataaaaggctgta

SEQ ID NO: 490766 - DNA, 15 bp, Homo sapiens
gataaaaggctgtaa

SEQ ID NO: 490767 - DNA, 15 bp, Homo sapiens
ataaaaggctgtaag

SEQ ID NO: 490768 - DNA, 15 bp, Homo sapiens
taaaaggctgtaagg

SEQ ID NO: 490769 - DNA, 15 bp, Homo sapiens
aaaaggctgtaaggt

SEQ ID NO: 490770 - DNA, 15 bp, Homo sapiens
aaaggctgtaaggtt

SEQ ID NO: 490771 - DNA, 15 bp, Homo sapiens
aaggctgtaaggtta

SEQ ID NO: 490772 - DNA, 15 bp, Homo sapiens
aggctgtaaggttaa

SEQ ID NO: 490773 - DNA, 15 bp, Homo sapiens
ggctgtaaggttaaa

SEQ ID NO: 490774 - DNA, 15 bp, Homo sapiens
gctgtaaggttaaaa

SEQ ID NO: 490775 - DNA, 15 bp, Homo sapiens
ctgtaaggttaaaag

SEQ ID NO: 490776 - DNA, 15 bp, Homo sapiens
tgtaaggttaaaagt

SEQ ID NO: 490777 - DNA, 15 bp, Homo sapiens
gtaaggttaaaagta

SEQ ID NO: 490778 - DNA, 15 bp, Homo sapiens
taaggttaaaagtat

SEQ ID NO: 490779 - DNA, 15 bp, Homo sapiens
aaggttaaaagtatt

SEQ ID NO: 490780 - DNA, 15 bp, Homo sapiens
aggttaaaagtattg

SEQ ID NO: 490781 - DNA, 15 bp, Homo sapiens
ggttaaaagtattgg

SEQ ID NO: 490782 - DNA, 15 bp, Homo sapiens
gttaaaagtattggt

SEQ ID NO: 490783 - DNA, 15 bp, Homo sapiens
aaaagtattggttta

SEQ ID NO: 490784 - DNA, 15 bp, Homo sapiens
aaagtattggtttag

SEQ ID NO: 490785 - DNA, 15 bp, Homo sapiens
aagtattggtttaga

SEQ ID NO: 490786 - DNA, 15 bp, Homo sapiens
agtattggtttagag

SEQ ID NO: 490787 - DNA, 15 bp, Homo sapiens
gtattggtttagagc

SEQ ID NO: 490788 - DNA, 15 bp, Homo sapiens
tattggtttagagca

SEQ ID NO: 490789 - DNA, 15 bp, Homo sapiens
attggtttagagcaa

SEQ ID NO: 490790 - DNA, 15 bp, Homo sapiens
ttggtttagagcaaa

SEQ ID NO: 490791 - DNA, 15 bp, Homo sapiens
tggtttagagcaaaa

SEQ ID NO: 490792 - DNA, 15 bp, Homo sapiens
ggtttagagcaaaat

SEQ ID NO: 490793 - DNA, 15 bp, Homo sapiens
gtttagagcaaaatg

SEQ ID NO: 490794 - DNA, 15 bp, Homo sapiens
tttagagcaaaatgg

SEQ ID NO: 490795 - DNA, 15 bp, Homo sapiens
ttagagcaaaatgga

SEQ ID NO: 490796 - DNA, 15 bp, Homo sapiens
tagagcaaaatggat

SEQ ID NO: 490797 - DNA, 15 bp, Homo sapiens
agagcaaaatggatt

SEQ ID NO: 490798 - DNA, 15 bp, Homo sapiens
gagcaaaatggatta

SEQ ID NO: 490799 - DNA, 15 bp, Homo sapiens
agcaaaatggattag

SEQ ID NO: 490800 - DNA, 15 bp, Homo sapiens
gcaaaatggattaga

SEQ ID NO: 490801 - DNA, 15 bp, Homo sapiens
caaaatggattagac

SEQ ID NO: 490802 - DNA, 15 bp, Homo sapiens
aaaatggattagact

SEQ ID NO: 490803 - DNA, 15 bp, Homo sapiens
aaatggattagactt

SEQ ID NO: 490804 - DNA, 15 bp, Homo sapiens
aatggattagacttc

SEQ ID NO: 490805 - DNA, 15 bp, Homo sapiens
atggattagacttct

SEQ ID NO: 490806 - DNA, 15 bp, Homo sapiens
tggattagacttctg

SEQ ID NO: 490807 - DNA, 15 bp, Homo sapiens
ggattagacttctgt

SEQ ID NO: 490808 - DNA, 15 bp, Homo sapiens
gattagacttctgtc

SEQ ID NO: 490809 - DNA, 15 bp, Homo sapiens
attagacttctgtct

SEQ ID NO: 490810 - DNA, 15 bp, Homo sapiens
ttagacttctgtcta

SEQ ID NO: 490811 - DNA, 15 bp, Homo sapiens
tagacttctgtctag

SEQ ID NO: 490812 - DNA, 15 bp, Homo sapiens
agacttctgtctagg

SEQ ID NO: 490813 - DNA, 15 bp, Homo sapiens
gacttctgtctaggg

SEQ ID NO: 490814 - DNA, 15 bp, Homo sapiens
acttctgtctagggt

SEQ ID NO: 490815 - DNA, 15 bp, Homo sapiens
cttctgtctagggtt

SEQ ID NO: 490816 - DNA, 15 bp, Homo sapiens
ttctgtctagggttt

SEQ ID NO: 490817 - DNA, 15 bp, Homo sapiens
tctgtctagggtttg

SEQ ID NO: 490818 - DNA, 15 bp, Homo sapiens
ctgtctagggtttgg

SEQ ID NO: 490819 - DNA, 15 bp, Homo sapiens
tgtctagggtttggc

SEQ ID NO: 490820 - DNA, 15 bp, Homo sapiens
gtctagggtttggct

SEQ ID NO: 490821 - DNA, 15 bp, Homo sapiens
tctagggtttggcta

SEQ ID NO: 490822 - DNA, 15 bp, Homo sapiens
ctagggtttggctat

SEQ ID NO: 490823 - DNA, 15 bp, Homo sapiens
tagggtttggctatt

SEQ ID NO: 490824 - DNA, 15 bp, Homo sapiens
agggtttggctattt

SEQ ID NO: 490825 - DNA, 15 bp, Homo sapiens
gggtttggctatttg

SEQ ID NO: 490826 - DNA, 15 bp, Homo sapiens
ggtttggctatttgt

SEQ ID NO: 490827 - DNA, 15 bp, Homo sapiens
gtttggctatttgtt

SEQ ID NO: 490828 - DNA, 15 bp, Homo sapiens
tttggctatttgtta

SEQ ID NO: 490829 - DNA, 15 bp, Homo sapiens
ttggctatttgttat

SEQ ID NO: 490830 - DNA, 15 bp, Homo sapiens
tggctatttgttata

SEQ ID NO: 490831 - DNA, 15 bp, Homo sapiens
ggctatttgttatat

SEQ ID NO: 490832 - DNA, 15 bp, Homo sapiens
gctatttgttatatt

SEQ ID NO: 490833 - DNA, 15 bp, Homo sapiens
ctatttgttatattt

SEQ ID NO: 490834 - DNA, 15 bp, Homo sapiens
tatttgttatatttg

SEQ ID NO: 490835 - DNA, 15 bp, Homo sapiens
atttgttatatttgt

SEQ ID NO: 490836 - DNA, 15 bp, Homo sapiens
tttgttatatttgtt

SEQ ID NO: 490837 - DNA, 15 bp, Homo sapiens
ttgttatatttgtta

SEQ ID NO: 490838 - DNA, 15 bp, Homo sapiens
tgttatatttgttac

SEQ ID NO: 490839 - DNA, 15 bp, Homo sapiens
gttatatttgttact

SEQ ID NO: 490840 - DNA, 15 bp, Homo sapiens
ttatatttgttactt

SEQ ID NO: 490841 - DNA, 15 bp, Homo sapiens
tatatttgttacttg

SEQ ID NO: 490842 - DNA, 15 bp, Homo sapiens
atatttgttacttgc

SEQ ID NO: 490843 - DNA, 15 bp, Homo sapiens
tatttgttacttgca

SEQ ID NO: 490844 - DNA, 15 bp, Homo sapiens
atttgttacttgcaa

SEQ ID NO: 490845 - DNA, 15 bp, Homo sapiens
tttgttacttgcaag

SEQ ID NO: 490846 - DNA, 15 bp, Homo sapiens
ttgttacttgcaaga

SEQ ID NO: 490847 - DNA, 15 bp, Homo sapiens
tgttacttgcaagag

SEQ ID NO: 490848 - DNA, 15 bp, Homo sapiens
gttacttgcaagaga

SEQ ID NO: 490849 - DNA, 15 bp, Homo sapiens
ttacttgcaagagaa

SEQ ID NO: 490850 - DNA, 15 bp, Homo sapiens
tacttgcaagagaag

SEQ ID NO: 490851 - DNA, 15 bp, Homo sapiens
acttgcaagagaagc

SEQ ID NO: 490852 - DNA, 15 bp, Homo sapiens
cttgcaagagaagca

SEQ ID NO: 490853 - DNA, 15 bp, Homo sapiens
ttgcaagagaagcat

SEQ ID NO: 490854 - DNA, 15 bp, Homo sapiens
tgcaagagaagcata

SEQ ID NO: 490855 - DNA, 15 bp, Homo sapiens
gcaagagaagcataa

SEQ ID NO: 490856 - DNA, 15 bp, Homo sapiens
caagagaagcataac

SEQ ID NO: 490857 - DNA, 15 bp, Homo sapiens
aagagaagcataact

SEQ ID NO: 490858 - DNA, 15 bp, Homo sapiens
agagaagcataactc

SEQ ID NO: 490859 - DNA, 15 bp, Homo sapiens
gagaagcataactct

SEQ ID NO: 490860 - DNA, 15 bp, Homo sapiens
agaagcataactctg

SEQ ID NO: 490861 - DNA, 15 bp, Homo sapiens
gaagcataactctgt

SEQ ID NO: 490862 - DNA, 15 bp, Homo sapiens
aagcataactctgtc

SEQ ID NO: 490863 - DNA, 15 bp, Homo sapiens
agcataactctgtct

SEQ ID NO: 490864 - DNA, 15 bp, Homo sapiens
gcataactctgtctg

SEQ ID NO: 490865 - DNA, 15 bp, Homo sapiens
cataactctgtctgt

SEQ ID NO: 490866 - DNA, 15 bp, Homo sapiens
ataactctgtctgtt

SEQ ID NO: 490867 - DNA, 15 bp, Homo sapiens
taactctgtctgttt

SEQ ID NO: 490868 - DNA, 15 bp, Homo sapiens
aactctgtctgtttt

SEQ ID NO: 490869 - DNA, 15 bp, Homo sapiens
actctgtctgtttta

SEQ ID NO: 490870 - DNA, 15 bp, Homo sapiens
ctctgtctgttttaa

SEQ ID NO: 490871 - DNA, 15 bp, Homo sapiens
tctgtctgttttaaa

SEQ ID NO: 490872 - DNA, 15 bp, Homo sapiens
ctgtctgttttaaaa

SEQ ID NO: 490873 - DNA, 15 bp, Homo sapiens
tgtctgttttaaaaa

SEQ ID NO: 490874 - DNA, 15 bp, Homo sapiens
gtctgttttaaaaag

SEQ ID NO: 490875 - DNA, 15 bp, Homo sapiens
tctgttttaaaaaga

SEQ ID NO: 490876 - DNA, 15 bp, Homo sapiens
ctgttttaaaaagag

SEQ ID NO: 490877 - DNA, 15 bp, Homo sapiens
tgttttaaaaagagt

SEQ ID NO: 490878 - DNA, 15 bp, Homo sapiens
gttttaaaaagagtg

SEQ ID NO: 490879 - DNA, 15 bp, Homo sapiens
ttttaaaaagagtgt

SEQ ID NO: 490880 - DNA, 15 bp, Homo sapiens
tttaaaaagagtgtg

SEQ ID NO: 490881 - DNA, 15 bp, Homo sapiens
ttaaaaagagtgtgt

SEQ ID NO: 490882 - DNA, 15 bp, Homo sapiens
taaaaagagtgtgta

SEQ ID NO: 490883 - DNA, 15 bp, Homo sapiens
aaaaagagtgtgtaa

SEQ ID NO: 490884 - DNA, 15 bp, Homo sapiens
aaaagagtgtgtaaa

SEQ ID NO: 490885 - DNA, 15 bp, Homo sapiens
aaagagtgtgtaaac

SEQ ID NO: 490886 - DNA, 15 bp, Homo sapiens
aagagtgtgtaaacc

SEQ ID NO: 490887 - DNA, 15 bp, Homo sapiens
agagtgtgtaaacct

SEQ ID NO: 490888 - DNA, 15 bp, Homo sapiens
gagtgtgtaaaccta

SEQ ID NO: 490889 - DNA, 15 bp, Homo sapiens
agtgtgtaaacctat

SEQ ID NO: 490890 - DNA, 15 bp, Homo sapiens
gtgtgtaaacctatg

SEQ ID NO: 490891 - DNA, 15 bp, Homo sapiens
tgtgtaaacctatgg

SEQ ID NO: 490892 - DNA, 15 bp, Homo sapiens
gtgtaaacctatggt

SEQ ID NO: 490893 - DNA, 15 bp, Homo sapiens
tgtaaacctatggtg

SEQ ID NO: 490894 - DNA, 15 bp, Homo sapiens
gtaaacctatggtgt

SEQ ID NO: 490895 - DNA, 15 bp, Homo sapiens
taaacctatggtgta

SEQ ID NO: 490896 - DNA, 15 bp, Homo sapiens
aaacctatggtgtac

SEQ ID NO: 490897 - DNA, 15 bp, Homo sapiens
aacctatggtgtact

SEQ ID NO: 490898 - DNA, 15 bp, Homo sapiens
acctatggtgtactt

SEQ ID NO: 490899 - DNA, 15 bp, Homo sapiens
cctatggtgtactta

SEQ ID NO: 490900 - DNA, 15 bp, Homo sapiens
ctatggtgtacttaa

SEQ ID NO: 490901 - DNA, 15 bp, Homo sapiens
tatggtgtacttaat

SEQ ID NO: 490902 - DNA, 15 bp, Homo sapiens
atggtgtacttaata

SEQ ID NO: 490903 - DNA, 15 bp, Homo sapiens
tggtgtacttaataa

SEQ ID NO: 490904 - DNA, 15 bp, Homo sapiens
ggtgtacttaataat

SEQ ID NO: 490905 - DNA, 15 bp, Homo sapiens
gtgtacttaataata

SEQ ID NO: 490906 - DNA, 15 bp, Homo sapiens
tgtacttaataataa

SEQ ID NO: 490907 - DNA, 15 bp, Homo sapiens
gtacttaataataat

SEQ ID NO: 490908 - DNA, 15 bp, Homo sapiens
tacttaataataatt

SEQ ID NO: 490909 - DNA, 15 bp, Homo sapiens
acttaataataattc

SEQ ID NO: 490910 - DNA, 15 bp, Homo sapiens
cttaataataattca

SEQ ID NO: 490911 - DNA, 15 bp, Homo sapiens
ttaataataattcaa

SEQ ID NO: 490912 - DNA, 15 bp, Homo sapiens
taataataattcaac

SEQ ID NO: 490913 - DNA, 15 bp, Homo sapiens
aataataattcaact

SEQ ID NO: 490914 - DNA, 15 bp, Homo sapiens
ataataattcaactc

SEQ ID NO: 490915 - DNA, 15 bp, Homo sapiens
taataattcaactca

SEQ ID NO: 490916 - DNA, 15 bp, Homo sapiens
aataattcaactcag

SEQ ID NO: 490917 - DNA, 15 bp, Homo sapiens
ataattcaactcagc

SEQ ID NO: 490918 - DNA, 15 bp, Homo sapiens
taattcaactcagct

SEQ ID NO: 490919 - DNA, 15 bp, Homo sapiens
aattcaactcagcta

SEQ ID NO: 490920 - DNA, 15 bp, Homo sapiens
attcaactcagctat

SEQ ID NO: 490921 - DNA, 15 bp, Homo sapiens
ttcaactcagctatc

SEQ ID NO: 490922 - DNA, 15 bp, Homo sapiens
tcaactcagctatcc

SEQ ID NO: 490923 - DNA, 15 bp, Homo sapiens
caactcagctatccc

SEQ ID NO: 490924 - DNA, 15 bp, Homo sapiens
aactcagctatccct

SEQ ID NO: 490925 - DNA, 15 bp, Homo sapiens
actcagctatccctt

SEQ ID NO: 490926 - DNA, 15 bp, Homo sapiens
ctcagctatcccttg

SEQ ID NO: 490927 - DNA, 15 bp, Homo sapiens
tcagctatcccttgg

SEQ ID NO: 490928 - DNA, 15 bp, Homo sapiens
cagctatcccttgga

SEQ ID NO: 490929 - DNA, 15 bp, Homo sapiens
agctatcccttggac

SEQ ID NO: 490930 - DNA, 15 bp, Homo sapiens
gctatcccttggaca

SEQ ID NO: 490931 - DNA, 15 bp, Homo sapiens
ctatcccttggacac

SEQ ID NO: 490932 - DNA, 15 bp, Homo sapiens
tatcccttggacact

SEQ ID NO: 490933 - DNA, 15 bp, Homo sapiens
atcccttggacactg

SEQ ID NO: 490934 - DNA, 15 bp, Homo sapiens
tcccttggacactgt

SEQ ID NO: 490935 - DNA, 15 bp, Homo sapiens
cccttggacactgtg

SEQ ID NO: 490936 - DNA, 15 bp, Homo sapiens
ccttggacactgtgg

SEQ ID NO: 490937 - DNA, 15 bp, Homo sapiens
cttggacactgtgga

SEQ ID NO: 490938 - DNA, 15 bp, Homo sapiens
ttggacactgtggag

SEQ ID NO: 490939 - DNA, 15 bp, Homo sapiens
tggacactgtggagg

SEQ ID NO: 490940 - DNA, 15 bp, Homo sapiens
ggacactgtggaggt

SEQ ID NO: 490941 - DNA, 15 bp, Homo sapiens
gacactgtggaggtc

SEQ ID NO: 490942 - DNA, 15 bp, Homo sapiens
acactgtggaggtcc

SEQ ID NO: 490943 - DNA, 15 bp, Homo sapiens
cactgtggaggtcca

SEQ ID NO: 490944 - DNA, 15 bp, Homo sapiens
actgtggaggtccac

SEQ ID NO: 490945 - DNA, 15 bp, Homo sapiens
ctgtggaggtccact

SEQ ID NO: 490946 - DNA, 15 bp, Homo sapiens
tgtggaggtccactc

SEQ ID NO: 490947 - DNA, 15 bp, Homo sapiens
gtggaggtccactct

SEQ ID NO: 490948 - DNA, 15 bp, Homo sapiens
tggaggtccactctt

SEQ ID NO: 490949 - DNA, 15 bp, Homo sapiens
ggaggtccactcttt

SEQ ID NO: 490950 - DNA, 15 bp, Homo sapiens
gaggtccactctttt

SEQ ID NO: 490951 - DNA, 15 bp, Homo sapiens
aggtccactcttttc

SEQ ID NO: 490952 - DNA, 15 bp, Homo sapiens
ggtccactcttttct

SEQ ID NO: 490953 - DNA, 15 bp, Homo sapiens
gtccactcttttctc

SEQ ID NO: 490954 - DNA, 15 bp, Homo sapiens
tccactcttttctcc

SEQ ID NO: 490955 - DNA, 15 bp, Homo sapiens
ccactcttttctcct

SEQ ID NO: 490956 - DNA, 15 bp, Homo sapiens
cactcttttctcctg

SEQ ID NO: 490957 - DNA, 15 bp, Homo sapiens
actcttttctcctgg

SEQ ID NO: 490958 - DNA, 15 bp, Homo sapiens
ctcttttctcctgga

SEQ ID NO: 490959 - DNA, 15 bp, Homo sapiens
tcttttctcctggat

SEQ ID NO: 490960 - DNA, 15 bp, Homo sapiens
cttttctcctggatg

SEQ ID NO: 490961 - DNA, 15 bp, Homo sapiens
ttttctcctggatgt

SEQ ID NO: 490962 - DNA, 15 bp, Homo sapiens
tttctcctggatgta

SEQ ID NO: 490963 - DNA, 15 bp, Homo sapiens
ttctcctggatgtaa

SEQ ID NO: 490964 - DNA, 15 bp, Homo sapiens
tctcctggatgtaac

SEQ ID NO: 490965 - DNA, 15 bp, Homo sapiens
ctcctggatgtaact

SEQ ID NO: 490966 - DNA, 15 bp, Homo sapiens
tcctggatgtaactt

SEQ ID NO: 490967 - DNA, 15 bp, Homo sapiens
cctggatgtaactta

SEQ ID NO: 490968 - DNA, 15 bp, Homo sapiens
ctggatgtaacttac

SEQ ID NO: 490969 - DNA, 15 bp, Homo sapiens
tggatgtaacttaca

SEQ ID NO: 490970 - DNA, 15 bp, Homo sapiens
ggatgtaacttacag

SEQ ID NO: 490971 - DNA, 15 bp, Homo sapiens
gatgtaacttacaga

SEQ ID NO: 490972 - DNA, 15 bp, Homo sapiens
atgtaacttacagat

SEQ ID NO: 490973 - DNA, 15 bp, Homo sapiens
tgtaacttacagatc

SEQ ID NO: 490974 - DNA, 15 bp, Homo sapiens
gtaacttacagatct

SEQ ID NO: 490975 - DNA, 15 bp, Homo sapiens
taacttacagatctg

SEQ ID NO: 490976 - DNA, 15 bp, Homo sapiens
aacttacagatctgt

SEQ ID NO: 490977 - DNA, 15 bp, Homo sapiens
acttacagatctgtt

SEQ ID NO: 490978 - DNA, 15 bp, Homo sapiens
cttacagatctgtta

SEQ ID NO: 490979 - DNA, 15 bp, Homo sapiens
ttacagatctgttag

SEQ ID NO: 490980 - DNA, 15 bp, Homo sapiens
tacagatctgttaga

SEQ ID NO: 490981 - DNA, 15 bp, Homo sapiens
acagatctgttagaa

SEQ ID NO: 490982 - DNA, 15 bp, Homo sapiens
cagatctgttagaac

SEQ ID NO: 490983 - DNA, 15 bp, Homo sapiens
agatctgttagaact

SEQ ID NO: 490984 - DNA, 15 bp, Homo sapiens
gatctgttagaacta

SEQ ID NO: 490985 - DNA, 15 bp, Homo sapiens
atctgttagaactag

SEQ ID NO: 490986 - DNA, 15 bp, Homo sapiens
tctgttagaactagg

SEQ ID NO: 490987 - DNA, 15 bp, Homo sapiens
ctgttagaactaggc

SEQ ID NO: 490988 - DNA, 15 bp, Homo sapiens
tgttagaactaggct

SEQ ID NO: 490989 - DNA, 15 bp, Homo sapiens
gttagaactaggctt

SEQ ID NO: 490990 - DNA, 15 bp, Homo sapiens
ttagaactaggcttc

SEQ ID NO: 490991 - DNA, 15 bp, Homo sapiens
tagaactaggcttct

SEQ ID NO: 490992 - DNA, 15 bp, Homo sapiens
agaactaggcttctt

SEQ ID NO: 490993 - DNA, 15 bp, Homo sapiens
gaactaggcttcttt

SEQ ID NO: 490994 - DNA, 15 bp, Homo sapiens
aactaggcttctttt

SEQ ID NO: 490995 - DNA, 15 bp, Homo sapiens
actaggcttctttta

SEQ ID NO: 490996 - DNA, 15 bp, Homo sapiens
ctaggcttcttttag

SEQ ID NO: 490997 - DNA, 15 bp, Homo sapiens
taggcttcttttagc

SEQ ID NO: 490998 - DNA, 15 bp, Homo sapiens
aggcttcttttagcc

SEQ ID NO: 490999 - DNA, 15 bp, Homo sapiens
ggcttcttttagcct

SEQ ID NO: 491000 - DNA, 15 bp, Homo sapiens
gcttcttttagcctg

SEQ ID NO: 491001 - DNA, 15 bp, Homo sapiens
cttcttttagcctga

SEQ ID NO: 491002 - DNA, 15 bp, Homo sapiens
ttcttttagcctgat

SEQ ID NO: 491003 - DNA, 15 bp, Homo sapiens
tcttttagcctgatt

SEQ ID NO: 491004 - DNA, 15 bp, Homo sapiens
cttttagcctgattt

SEQ ID NO: 491005 - DNA, 15 bp, Homo sapiens
ttttagcctgatttc

SEQ ID NO: 491006 - DNA, 15 bp, Homo sapiens
tttagcctgatttct

SEQ ID NO: 491007 - DNA, 15 bp, Homo sapiens
ttagcctgatttctc

SEQ ID NO: 491008 - DNA, 15 bp, Homo sapiens
tagcctgatttctcc

SEQ ID NO: 491009 - DNA, 15 bp, Homo sapiens
agcctgatttctccc

SEQ ID NO: 491010 - DNA, 15 bp, Homo sapiens
gcctgatttctcccc

SEQ ID NO: 491011 - DNA, 15 bp, Homo sapiens
cctgatttctccccc

SEQ ID NO: 491012 - DNA, 15 bp, Homo sapiens
ctgatttctccccca

SEQ ID NO: 491013 - DNA, 15 bp, Homo sapiens
tgatttctcccccaa

SEQ ID NO: 491014 - DNA, 15 bp, Homo sapiens
gatttctcccccaaa

SEQ ID NO: 491015 - DNA, 15 bp, Homo sapiens
atttctcccccaaat

SEQ ID NO: 491016 - DNA, 15 bp, Homo sapiens
tttctcccccaaata

SEQ ID NO: 491017 - DNA, 15 bp, Homo sapiens
ttctcccccaaatac

SEQ ID NO: 491018 - DNA, 15 bp, Homo sapiens
tctcccccaaatacc

SEQ ID NO: 491019 - DNA, 15 bp, Homo sapiens
ctcccccaaataccg

SEQ ID NO: 491020 - DNA, 15 bp, Homo sapiens
tcccccaaataccgg

SEQ ID NO: 491021 - DNA, 15 bp, Homo sapiens
cccccaaataccggg

SEQ ID NO: 491022 - DNA, 15 bp, Homo sapiens
ccccaaataccgggc

SEQ ID NO: 491023 - DNA, 15 bp, Homo sapiens
cccaaataccgggcc

SEQ ID NO: 491024 - DNA, 15 bp, Homo sapiens
ccaaataccgggcct

SEQ ID NO: 491025 - DNA, 15 bp, Homo sapiens
caaataccgggcctc

SEQ ID NO: 491026 - DNA, 15 bp, Homo sapiens
aaataccgggcctca

SEQ ID NO: 491027 - DNA, 15 bp, Homo sapiens
aataccgggcctcac

SEQ ID NO: 491028 - DNA, 15 bp, Homo sapiens
ataccgggcctcaca

SEQ ID NO: 491029 - DNA, 15 bp, Homo sapiens
taccgggcctcacac

SEQ ID NO: 491030 - DNA, 15 bp, Homo sapiens
accgggcctcacact

SEQ ID NO: 491031 - DNA, 15 bp, Homo sapiens
ccgggcctcacactt

SEQ ID NO: 491032 - DNA, 15 bp, Homo sapiens
cgggcctcacacttt

SEQ ID NO: 491033 - DNA, 15 bp, Homo sapiens
gggcctcacactttc

SEQ ID NO: 491034 - DNA, 15 bp, Homo sapiens
ggcctcacactttcc

SEQ ID NO: 491035 - DNA, 15 bp, Homo sapiens
gcctcacactttccc

SEQ ID NO: 491036 - DNA, 15 bp, Homo sapiens
cctcacactttccct

SEQ ID NO: 491037 - DNA, 15 bp, Homo sapiens
ctcacactttccctc

SEQ ID NO: 491038 - DNA, 15 bp, Homo sapiens
tcacactttccctcc

SEQ ID NO: 491039 - DNA, 15 bp, Homo sapiens
cacactttccctcca

SEQ ID NO: 491040 - DNA, 15 bp, Homo sapiens
acactttccctccag

SEQ ID NO: 491041 - DNA, 15 bp, Homo sapiens
cactttccctccaga

SEQ ID NO: 491042 - DNA, 15 bp, Homo sapiens
actttccctccagac

SEQ ID NO: 491043 - DNA, 15 bp, Homo sapiens
ctttccctccagacg

SEQ ID NO: 491044 - DNA, 15 bp, Homo sapiens
tttccctccagacgt

SEQ ID NO: 491045 - DNA, 15 bp, Homo sapiens
ttccctccagacgtt

SEQ ID NO: 491046 - DNA, 15 bp, Homo sapiens
tccctccagacgtta

SEQ ID NO: 491047 - DNA, 15 bp, Homo sapiens
ccctccagacgttat

SEQ ID NO: 491048 - DNA, 15 bp, Homo sapiens
cctccagacgttata

SEQ ID NO: 491049 - DNA, 15 bp, Homo sapiens
ctccagacgttatag

SEQ ID NO: 491050 - DNA, 15 bp, Homo sapiens
tccagacgttatagg

SEQ ID NO: 491051 - DNA, 15 bp, Homo sapiens
ccagacgttatagga

SEQ ID NO: 491052 - DNA, 15 bp, Homo sapiens
cagacgttataggaa

SEQ ID NO: 491053 - DNA, 15 bp, Homo sapiens
agacgttataggaag

SEQ ID NO: 491054 - DNA, 15 bp, Homo sapiens
gacgttataggaagg

SEQ ID NO: 491055 - DNA, 15 bp, Homo sapiens
acgttataggaaggg

SEQ ID NO: 491056 - DNA, 15 bp, Homo sapiens
cgttataggaagggt

SEQ ID NO: 491057 - DNA, 15 bp, Homo sapiens
gttataggaagggta

SEQ ID NO: 491058 - DNA, 15 bp, Homo sapiens
ttataggaagggtac

SEQ ID NO: 491059 - DNA, 15 bp, Homo sapiens
tataggaagggtact

SEQ ID NO: 491060 - DNA, 15 bp, Homo sapiens
ataggaagggtactc

SEQ ID NO: 491061 - DNA, 15 bp, Homo sapiens
taggaagggtactct

SEQ ID NO: 491062 - DNA, 15 bp, Homo sapiens
aggaagggtactctt

SEQ ID NO: 491063 - DNA, 15 bp, Homo sapiens
ggaagggtactcttc

SEQ ID NO: 491064 - DNA, 15 bp, Homo sapiens
gaagggtactcttca

SEQ ID NO: 491065 - DNA, 15 bp, Homo sapiens
aagggtactcttcat

SEQ ID NO: 491066 - DNA, 15 bp, Homo sapiens
agggtactcttcatg

SEQ ID NO: 491067 - DNA, 15 bp, Homo sapiens
gggtactcttcatgc

SEQ ID NO: 491068 - DNA, 15 bp, Homo sapiens
ggtactcttcatgcc

SEQ ID NO: 491069 - DNA, 15 bp, Homo sapiens
gtactcttcatgcct

SEQ ID NO: 491070 - DNA, 15 bp, Homo sapiens
tactcttcatgcctg

SEQ ID NO: 491071 - DNA, 15 bp, Homo sapiens
actcttcatgcctgc

SEQ ID NO: 491072 - DNA, 15 bp, Homo sapiens
ctcttcatgcctgct

SEQ ID NO: 491073 - DNA, 15 bp, Homo sapiens
tcttcatgcctgctc

SEQ ID NO: 491074 - DNA, 15 bp, Homo sapiens
cttcatgcctgctct

SEQ ID NO: 491075 - DNA, 15 bp, Homo sapiens
ttcatgcctgctctt

SEQ ID NO: 491076 - DNA, 15 bp, Homo sapiens
tcatgcctgctcttt

SEQ ID NO: 491077 - DNA, 15 bp, Homo sapiens
catgcctgctctttt

SEQ ID NO: 491078 - DNA, 15 bp, Homo sapiens
atgcctgctcttttt

SEQ ID NO: 491079 - DNA, 15 bp, Homo sapiens
tgcctgctctttttt

SEQ ID NO: 491080 - DNA, 15 bp, Homo sapiens
gcctgctcttttttt

SEQ ID NO: 491081 - DNA, 15 bp, Homo sapiens
cctgctctttttttc

SEQ ID NO: 491082 - DNA, 15 bp, Homo sapiens
ctgctctttttttct

SEQ ID NO: 491083 - DNA, 15 bp, Homo sapiens
tgctctttttttctc

SEQ ID NO: 491084 - DNA, 15 bp, Homo sapiens
gctctttttttctca

SEQ ID NO: 491085 - DNA, 15 bp, Homo sapiens
ctctttttttctcac

SEQ ID NO: 491086 - DNA, 15 bp, Homo sapiens
tctttttttctcaca

SEQ ID NO: 491087 - DNA, 15 bp, Homo sapiens
ctttttttctcacat

SEQ ID NO: 491088 - DNA, 15 bp, Homo sapiens
tttttttctcacata

SEQ ID NO: 491089 - DNA, 15 bp, Homo sapiens
ttttttctcacatag

SEQ ID NO: 491090 - DNA, 15 bp, Homo sapiens
tttttctcacatagc

SEQ ID NO: 491091 - DNA, 15 bp, Homo sapiens
ttttctcacatagct

SEQ ID NO: 491092 - DNA, 15 bp, Homo sapiens
tttctcacatagctc

SEQ ID NO: 491093 - DNA, 15 bp, Homo sapiens
ttctcacatagctcc

SEQ ID NO: 491094 - DNA, 15 bp, Homo sapiens
tctcacatagctccc

SEQ ID NO: 491095 - DNA, 15 bp, Homo sapiens
ctcacatagctccca

SEQ ID NO: 491096 - DNA, 15 bp, Homo sapiens
tcacatagctcccag

SEQ ID NO: 491097 - DNA, 15 bp, Homo sapiens
cacatagctcccagc

SEQ ID NO: 491098 - DNA, 15 bp, Homo sapiens
acatagctcccagca

SEQ ID NO: 491099 - DNA, 15 bp, Homo sapiens
catagctcccagcac

SEQ ID NO: 491100 - DNA, 15 bp, Homo sapiens
atagctcccagcaca

SEQ ID NO: 491101 - DNA, 15 bp, Homo sapiens
tagctcccagcacac

SEQ ID NO: 491102 - DNA, 15 bp, Homo sapiens
agctcccagcacaca

SEQ ID NO: 491103 - DNA, 15 bp, Homo sapiens
gctcccagcacacag

SEQ ID NO: 491104 - DNA, 15 bp, Homo sapiens
ctcccagcacacagc

SEQ ID NO: 491105 - DNA, 15 bp, Homo sapiens
tcccagcacacagca

SEQ ID NO: 491106 - DNA, 15 bp, Homo sapiens
cccagcacacagcac

SEQ ID NO: 491107 - DNA, 15 bp, Homo sapiens
ccagcacacagcaca

SEQ ID NO: 491108 - DNA, 15 bp, Homo sapiens
cagcacacagcacat

SEQ ID NO: 491109 - DNA, 15 bp, Homo sapiens
agcacacagcacatg

SEQ ID NO: 491110 - DNA, 15 bp, Homo sapiens
gcacacagcacatgg

SEQ ID NO: 491111 - DNA, 15 bp, Homo sapiens
cacacagcacatggt

SEQ ID NO: 491112 - DNA, 15 bp, Homo sapiens
acacagcacatggtc

SEQ ID NO: 491113 - DNA, 15 bp, Homo sapiens
cacagcacatggtca

SEQ ID NO: 491114 - DNA, 15 bp, Homo sapiens
acagcacatggtcac

SEQ ID NO: 491115 - DNA, 15 bp, Homo sapiens
cagcacatggtcact

SEQ ID NO: 491116 - DNA, 15 bp, Homo sapiens
agcacatggtcactg

SEQ ID NO: 491117 - DNA, 15 bp, Homo sapiens
gcacatggtcactga

SEQ ID NO: 491118 - DNA, 15 bp, Homo sapiens
cacatggtcactgat

SEQ ID NO: 491119 - DNA, 15 bp, Homo sapiens
acatggtcactgatg

SEQ ID NO: 491120 - DNA, 15 bp, Homo sapiens
catggtcactgatgt

SEQ ID NO: 491121 - DNA, 15 bp, Homo sapiens
atggtcactgatgtc

SEQ ID NO: 491122 - DNA, 15 bp, Homo sapiens
tggtcactgatgtcc

SEQ ID NO: 491123 - DNA, 15 bp, Homo sapiens
ggtcactgatgtcct

SEQ ID NO: 491124 - DNA, 15 bp, Homo sapiens
gtcactgatgtcctt

SEQ ID NO: 491125 - DNA, 15 bp, Homo sapiens
tcactgatgtccttt

SEQ ID NO: 491126 - DNA, 15 bp, Homo sapiens
cactgatgtcctttc

SEQ ID NO: 491127 - DNA, 15 bp, Homo sapiens
actgatgtcctttct

SEQ ID NO: 491128 - DNA, 15 bp, Homo sapiens
ctgatgtcctttctc

SEQ ID NO: 491129 - DNA, 15 bp, Homo sapiens
tgatgtcctttctcc

SEQ ID NO: 491130 - DNA, 15 bp, Homo sapiens
gatgtcctttctccc

SEQ ID NO: 491131 - DNA, 15 bp, Homo sapiens
atgtcctttctccca

SEQ ID NO: 491132 - DNA, 15 bp, Homo sapiens
tgtcctttctcccac

SEQ ID NO: 491133 - DNA, 15 bp, Homo sapiens
gtcctttctcccact

SEQ ID NO: 491134 - DNA, 15 bp, Homo sapiens
tcctttctcccactc

SEQ ID NO: 491135 - DNA, 15 bp, Homo sapiens
cctttctcccactca

SEQ ID NO: 491136 - DNA, 15 bp, Homo sapiens
ctttctcccactcag

SEQ ID NO: 491137 - DNA, 15 bp, Homo sapiens
tttctcccactcagc

SEQ ID NO: 491138 - DNA, 15 bp, Homo sapiens
ttctcccactcagca

SEQ ID NO: 491139 - DNA, 15 bp, Homo sapiens
tctcccactcagcat

SEQ ID NO: 491140 - DNA, 15 bp, Homo sapiens
ctcccactcagcata

SEQ ID NO: 491141 - DNA, 15 bp, Homo sapiens
tcccactcagcatag

SEQ ID NO: 491142 - DNA, 15 bp, Homo sapiens
cccactcagcataga

SEQ ID NO: 491143 - DNA, 15 bp, Homo sapiens
ccactcagcatagaa

SEQ ID NO: 491144 - DNA, 15 bp, Homo sapiens
cactcagcatagaac

SEQ ID NO: 491145 - DNA, 15 bp, Homo sapiens
actcagcatagaaca

SEQ ID NO: 491146 - DNA, 15 bp, Homo sapiens
ctcagcatagaacag

SEQ ID NO: 491147 - DNA, 15 bp, Homo sapiens
tcagcatagaacagt

SEQ ID NO: 491148 - DNA, 15 bp, Homo sapiens
cagcatagaacagtg

SEQ ID NO: 491149 - DNA, 15 bp, Homo sapiens
agcatagaacagtga

SEQ ID NO: 491150 - DNA, 15 bp, Homo sapiens
gcatagaacagtgag

SEQ ID NO: 491151 - DNA, 15 bp, Homo sapiens
catagaacagtgaga

SEQ ID NO: 491152 - DNA, 15 bp, Homo sapiens
atagaacagtgagag

SEQ ID NO: 491153 - DNA, 15 bp, Homo sapiens
tagaacagtgagaga

SEQ ID NO: 491154 - DNA, 15 bp, Homo sapiens
agaacagtgagagat

SEQ ID NO: 491155 - DNA, 15 bp, Homo sapiens
gaacagtgagagatg

SEQ ID NO: 491156 - DNA, 15 bp, Homo sapiens
aacagtgagagatgg

SEQ ID NO: 491157 - DNA, 15 bp, Homo sapiens
acagtgagagatgga

SEQ ID NO: 491158 - DNA, 15 bp, Homo sapiens
cagtgagagatggaa

SEQ ID NO: 491159 - DNA, 15 bp, Homo sapiens
agtgagagatggaag

SEQ ID NO: 491160 - DNA, 15 bp, Homo sapiens
gtgagagatggaagg

SEQ ID NO: 491161 - DNA, 15 bp, Homo sapiens
tgagagatggaagga

SEQ ID NO: 491162 - DNA, 15 bp, Homo sapiens
gagagatggaaggag

SEQ ID NO: 491163 - DNA, 15 bp, Homo sapiens
agagatggaaggagt

SEQ ID NO: 491164 - DNA, 15 bp, Homo sapiens
gagatggaaggagtg

SEQ ID NO: 491165 - DNA, 15 bp, Homo sapiens
agatggaaggagtgc

SEQ ID NO: 491166 - DNA, 15 bp, Homo sapiens
gatggaaggagtgca

SEQ ID NO: 491167 - DNA, 15 bp, Homo sapiens
atggaaggagtgcag

SEQ ID NO: 491168 - DNA, 15 bp, Homo sapiens
tggaaggagtgcagc

SEQ ID NO: 491169 - DNA, 15 bp, Homo sapiens
ggaaggagtgcagca

SEQ ID NO: 491170 - DNA, 15 bp, Homo sapiens
gaaggagtgcagcat

SEQ ID NO: 491171 - DNA, 15 bp, Homo sapiens
aaggagtgcagcatg

SEQ ID NO: 491172 - DNA, 15 bp, Homo sapiens
aggagtgcagcatgc

SEQ ID NO: 491173 - DNA, 15 bp, Homo sapiens
ggagtgcagcatgct

SEQ ID NO: 491174 - DNA, 15 bp, Homo sapiens
gagtgcagcatgcta

SEQ ID NO: 491175 - DNA, 15 bp, Homo sapiens
agtgcagcatgctag

SEQ ID NO: 491176 - DNA, 15 bp, Homo sapiens
gtgcagcatgctaga

SEQ ID NO: 491177 - DNA, 15 bp, Homo sapiens
tgcagcatgctagat

SEQ ID NO: 491178 - DNA, 15 bp, Homo sapiens
gcagcatgctagatg

SEQ ID NO: 491179 - DNA, 15 bp, Homo sapiens
cagcatgctagatga

SEQ ID NO: 491180 - DNA, 15 bp, Homo sapiens
agcatgctagatgac

SEQ ID NO: 491181 - DNA, 15 bp, Homo sapiens
gcatgctagatgact

SEQ ID NO: 491182 - DNA, 15 bp, Homo sapiens
catgctagatgacta

SEQ ID NO: 491183 - DNA, 15 bp, Homo sapiens
atgctagatgactag

SEQ ID NO: 491184 - DNA, 15 bp, Homo sapiens
tgctagatgactagg

SEQ ID NO: 491185 - DNA, 15 bp, Homo sapiens
gctagatgactaggg

SEQ ID NO: 491186 - DNA, 15 bp, Homo sapiens
ctagatgactaggga

SEQ ID NO: 491187 - DNA, 15 bp, Homo sapiens
tagatgactagggac

SEQ ID NO: 491188 - DNA, 15 bp, Homo sapiens
agatgactagggaca

SEQ ID NO: 491189 - DNA, 15 bp, Homo sapiens
gatgactagggacaa

SEQ ID NO: 491190 - DNA, 15 bp, Homo sapiens
atgactagggacaac

SEQ ID NO: 491191 - DNA, 15 bp, Homo sapiens
tgactagggacaact

SEQ ID NO: 491192 - DNA, 15 bp, Homo sapiens
gactagggacaactt

SEQ ID NO: 491193 - DNA, 15 bp, Homo sapiens
actagggacaacttt

SEQ ID NO: 491194 - DNA, 15 bp, Homo sapiens
ctagggacaactttt

SEQ ID NO: 491195 - DNA, 15 bp, Homo sapiens
tagggacaactttta

SEQ ID NO: 491196 - DNA, 15 bp, Homo sapiens
agggacaacttttat

SEQ ID NO: 491197 - DNA, 15 bp, Homo sapiens
gggacaacttttatt

SEQ ID NO: 491198 - DNA, 15 bp, Homo sapiens
ggacaacttttattt

SEQ ID NO: 491199 - DNA, 15 bp, Homo sapiens
gacaacttttatttg

SEQ ID NO: 491200 - DNA, 15 bp, Homo sapiens
acaacttttatttga

SEQ ID NO: 491201 - DNA, 15 bp, Homo sapiens
caacttttatttgac

SEQ ID NO: 491202 - DNA, 15 bp, Homo sapiens
aacttttatttgacc

SEQ ID NO: 491203 - DNA, 15 bp, Homo sapiens
acttttatttgacca

SEQ ID NO: 491204 - DNA, 15 bp, Homo sapiens
cttttatttgaccaa

SEQ ID NO: 491205 - DNA, 15 bp, Homo sapiens
ttttatttgaccaag

SEQ ID NO: 491206 - DNA, 15 bp, Homo sapiens
tttatttgaccaaga

SEQ ID NO: 491207 - DNA, 15 bp, Homo sapiens
ttatttgaccaagaa

SEQ ID NO: 491208 - DNA, 15 bp, Homo sapiens
tatttgaccaagaac

SEQ ID NO: 491209 - DNA, 15 bp, Homo sapiens
atttgaccaagaaca

SEQ ID NO: 491210 - DNA, 15 bp, Homo sapiens
tttgaccaagaacag

SEQ ID NO: 491211 - DNA, 15 bp, Homo sapiens
ttgaccaagaacaga

SEQ ID NO: 491212 - DNA, 15 bp, Homo sapiens
tgaccaagaacagat

SEQ ID NO: 491213 - DNA, 15 bp, Homo sapiens
gaccaagaacagatt

SEQ ID NO: 491214 - DNA, 15 bp, Homo sapiens
accaagaacagattg

SEQ ID NO: 491215 - DNA, 15 bp, Homo sapiens
ccaagaacagattgt

SEQ ID NO: 491216 - DNA, 15 bp, Homo sapiens
caagaacagattgtt

SEQ ID NO: 491217 - DNA, 15 bp, Homo sapiens
aagaacagattgttg

SEQ ID NO: 491218 - DNA, 15 bp, Homo sapiens
agaacagattgttgc

SEQ ID NO: 491219 - DNA, 15 bp, Homo sapiens
gaacagattgttgcc

SEQ ID NO: 491220 - DNA, 15 bp, Homo sapiens
aacagattgttgcca

SEQ ID NO: 491221 - DNA, 15 bp, Homo sapiens
acagattgttgccat

SEQ ID NO: 491222 - DNA, 15 bp, Homo sapiens
cagattgttgccatt

SEQ ID NO: 491223 - DNA, 15 bp, Homo sapiens
agattgttgccatta

SEQ ID NO: 491224 - DNA, 15 bp, Homo sapiens
gattgttgccattac

SEQ ID NO: 491225 - DNA, 15 bp, Homo sapiens
attgttgccattact

SEQ ID NO: 491226 - DNA, 15 bp, Homo sapiens
ttgttgccattactg

SEQ ID NO: 491227 - DNA, 15 bp, Homo sapiens
tgttgccattactgg

SEQ ID NO: 491228 - DNA, 15 bp, Homo sapiens
gttgccattactggg

SEQ ID NO: 491229 - DNA, 15 bp, Homo sapiens
ttgccattactgggg

SEQ ID NO: 491230 - DNA, 15 bp, Homo sapiens
tgccattactggggg

SEQ ID NO: 491231 - DNA, 15 bp, Homo sapiens
gccattactggggga

SEQ ID NO: 491232 - DNA, 15 bp, Homo sapiens
ccattactgggggac

SEQ ID NO: 491233 - DNA, 15 bp, Homo sapiens
cattactgggggaca

SEQ ID NO: 491234 - DNA, 15 bp, Homo sapiens
attactgggggacag

SEQ ID NO: 491235 - DNA, 15 bp, Homo sapiens
ttactgggggacaga

SEQ ID NO: 491236 - DNA, 15 bp, Homo sapiens
tactgggggacagat

SEQ ID NO: 491237 - DNA, 15 bp, Homo sapiens
actgggggacagatc

SEQ ID NO: 491238 - DNA, 15 bp, Homo sapiens
ctgggggacagatct

SEQ ID NO: 491239 - DNA, 15 bp, Homo sapiens
tgggggacagatctc

SEQ ID NO: 491240 - DNA, 15 bp, Homo sapiens
gggggacagatctcc

SEQ ID NO: 491241 - DNA, 15 bp, Homo sapiens
ggggacagatctcct

SEQ ID NO: 491242 - DNA, 15 bp, Homo sapiens
gggacagatctcctc

SEQ ID NO: 491243 - DNA, 15 bp, Homo sapiens
ggacagatctcctct

SEQ ID NO: 491244 - DNA, 15 bp, Homo sapiens
gacagatctcctctt

SEQ ID NO: 491245 - DNA, 15 bp, Homo sapiens
acagatctcctcttt

SEQ ID NO: 491246 - DNA, 15 bp, Homo sapiens
cagatctcctctttt

SEQ ID NO: 491247 - DNA, 15 bp, Homo sapiens
agatctcctcttttc

SEQ ID NO: 491248 - DNA, 15 bp, Homo sapiens
gatctcctcttttcc

SEQ ID NO: 491249 - DNA, 15 bp, Homo sapiens
atctcctcttttccc

SEQ ID NO: 491250 - DNA, 15 bp, Homo sapiens
tctcctcttttcccc

SEQ ID NO: 491251 - DNA, 15 bp, Homo sapiens
ctcctcttttccccc

SEQ ID NO: 491252 - DNA, 15 bp, Homo sapiens
tcctcttttcccccc

SEQ ID NO: 491253 - DNA, 15 bp, Homo sapiens
cctcttttcccccca

SEQ ID NO: 491254 - DNA, 15 bp, Homo sapiens
ctcttttccccccag

SEQ ID NO: 491255 - DNA, 15 bp, Homo sapiens
tcttttccccccagc

SEQ ID NO: 491256 - DNA, 15 bp, Homo sapiens
cttttccccccagca

SEQ ID NO: 491257 - DNA, 15 bp, Homo sapiens
ttttccccccagcat

SEQ ID NO: 491258 - DNA, 15 bp, Homo sapiens
tttccccccagcatt

SEQ ID NO: 491259 - DNA, 15 bp, Homo sapiens
ttccccccagcattg

SEQ ID NO: 491260 - DNA, 15 bp, Homo sapiens
tccccccagcattga

SEQ ID NO: 491261 - DNA, 15 bp, Homo sapiens
ccccccagcattgag

SEQ ID NO: 491262 - DNA, 15 bp, Homo sapiens
cccccagcattgaga

SEQ ID NO: 491263 - DNA, 15 bp, Homo sapiens
ccccagcattgagaa

SEQ ID NO: 491264 - DNA, 15 bp, Homo sapiens
cccagcattgagaac

SEQ ID NO: 491265 - DNA, 15 bp, Homo sapiens
ccagcattgagaacg

SEQ ID NO: 491266 - DNA, 15 bp, Homo sapiens
cagcattgagaacga

SEQ ID NO: 491267 - DNA, 15 bp, Homo sapiens
agcattgagaacgag

SEQ ID NO: 491268 - DNA, 15 bp, Homo sapiens
gcattgagaacgaga

SEQ ID NO: 491269 - DNA, 15 bp, Homo sapiens
cattgagaacgagat

SEQ ID NO: 491270 - DNA, 15 bp, Homo sapiens
attgagaacgagatg

SEQ ID NO: 491271 - DNA, 15 bp, Homo sapiens
ttgagaacgagatga

SEQ ID NO: 491272 - DNA, 15 bp, Homo sapiens
tgagaacgagatgat

SEQ ID NO: 491273 - DNA, 15 bp, Homo sapiens
gagaacgagatgatc

SEQ ID NO: 491274 - DNA, 15 bp, Homo sapiens
agaacgagatgatca

SEQ ID NO: 491275 - DNA, 15 bp, Homo sapiens
gaacgagatgatcat

SEQ ID NO: 491276 - DNA, 15 bp, Homo sapiens
aacgagatgatcatg

SEQ ID NO: 491277 - DNA, 15 bp, Homo sapiens
acgagatgatcatgt

SEQ ID NO: 491278 - DNA, 15 bp, Homo sapiens
cgagatgatcatgta

SEQ ID NO: 491279 - DNA, 15 bp, Homo sapiens
gagatgatcatgtag

SEQ ID NO: 491280 - DNA, 15 bp, Homo sapiens
agatgatcatgtagc

SEQ ID NO: 491281 - DNA, 15 bp, Homo sapiens
gatgatcatgtagca

SEQ ID NO: 491282 - DNA, 15 bp, Homo sapiens
atgatcatgtagcaa

SEQ ID NO: 491283 - DNA, 15 bp, Homo sapiens
tgatcatgtagcaaa

SEQ ID NO: 491284 - DNA, 15 bp, Homo sapiens
gatcatgtagcaaaa

SEQ ID NO: 491285 - DNA, 15 bp, Homo sapiens
atcatgtagcaaaag

SEQ ID NO: 491286 - DNA, 15 bp, Homo sapiens
tcatgtagcaaaaga

SEQ ID NO: 491287 - DNA, 15 bp, Homo sapiens
catgtagcaaaagag

SEQ ID NO: 491288 - DNA, 15 bp, Homo sapiens
atgtagcaaaagagg

SEQ ID NO: 491289 - DNA, 15 bp, Homo sapiens
tgtagcaaaagaggg

SEQ ID NO: 491290 - DNA, 15 bp, Homo sapiens
gtagcaaaagagggg

SEQ ID NO: 491291 - DNA, 15 bp, Homo sapiens
tagcaaaagagggga

SEQ ID NO: 491292 - DNA, 15 bp, Homo sapiens
agcaaaagaggggac

SEQ ID NO: 491293 - DNA, 15 bp, Homo sapiens
gcaaaagaggggacg

SEQ ID NO: 491294 - DNA, 15 bp, Homo sapiens
caaaagaggggacga

SEQ ID NO: 491295 - DNA, 15 bp, Homo sapiens
aaaagaggggacgaa

SEQ ID NO: 491296 - DNA, 15 bp, Homo sapiens
aaagaggggacgaaa

SEQ ID NO: 491297 - DNA, 15 bp, Homo sapiens
aagaggggacgaaaa

SEQ ID NO: 491298 - DNA, 15 bp, Homo sapiens
agaggggacgaaaag

SEQ ID NO: 491299 - DNA, 15 bp, Homo sapiens
gaggggacgaaaagc

SEQ ID NO: 491300 - DNA, 15 bp, Homo sapiens
aggggacgaaaagca

SEQ ID NO: 491301 - DNA, 15 bp, Homo sapiens
ggggacgaaaagcag

SEQ ID NO: 491302 - DNA, 15 bp, Homo sapiens
gggacgaaaagcaga

SEQ ID NO: 491303 - DNA, 15 bp, Homo sapiens
ggacgaaaagcagat

SEQ ID NO: 491304 - DNA, 15 bp, Homo sapiens
gacgaaaagcagatg

SEQ ID NO: 491305 - DNA, 15 bp, Homo sapiens
acgaaaagcagatgc

SEQ ID NO: 491306 - DNA, 15 bp, Homo sapiens
cgaaaagcagatgcc

SEQ ID NO: 491307 - DNA, 15 bp, Homo sapiens
gaaaagcagatgcct

SEQ ID NO: 491308 - DNA, 15 bp, Homo sapiens
aaaagcagatgcctt

SEQ ID NO: 491309 - DNA, 15 bp, Homo sapiens
aaagcagatgcctta

SEQ ID NO: 491310 - DNA, 15 bp, Homo sapiens
aagcagatgccttag

SEQ ID NO: 491311 - DNA, 15 bp, Homo sapiens
agcagatgccttaga

SEQ ID NO: 491312 - DNA, 15 bp, Homo sapiens
gcagatgccttagag

SEQ ID NO: 491313 - DNA, 15 bp, Homo sapiens
cagatgccttagaga

SEQ ID NO: 491314 - DNA, 15 bp, Homo sapiens
agatgccttagagaa

SEQ ID NO: 491315 - DNA, 15 bp, Homo sapiens
gatgccttagagaag

SEQ ID NO: 491316 - DNA, 15 bp, Homo sapiens
atgccttagagaaga

SEQ ID NO: 491317 - DNA, 15 bp, Homo sapiens
tgccttagagaagag

SEQ ID NO: 491318 - DNA, 15 bp, Homo sapiens
gccttagagaagaga

SEQ ID NO: 491319 - DNA, 15 bp, Homo sapiens
ccttagagaagagat

SEQ ID NO: 491320 - DNA, 15 bp, Homo sapiens
cttagagaagagatg

SEQ ID NO: 491321 - DNA, 15 bp, Homo sapiens
ttagagaagagatgg

SEQ ID NO: 491322 - DNA, 15 bp, Homo sapiens
tagagaagagatggc

SEQ ID NO: 491323 - DNA, 15 bp, Homo sapiens
agagaagagatggca

SEQ ID NO: 491324 - DNA, 15 bp, Homo sapiens
gagaagagatggcag

SEQ ID NO: 491325 - DNA, 15 bp, Homo sapiens
agaagagatggcagt

SEQ ID NO: 491326 - DNA, 15 bp, Homo sapiens
gaagagatggcagtg

SEQ ID NO: 491327 - DNA, 15 bp, Homo sapiens
aagagatggcagtgg

SEQ ID NO: 491328 - DNA, 15 bp, Homo sapiens
agagatggcagtggc

SEQ ID NO: 491329 - DNA, 15 bp, Homo sapiens
gagatggcagtggct

SEQ ID NO: 491330 - DNA, 15 bp, Homo sapiens
agatggcagtggctg

SEQ ID NO: 491331 - DNA, 15 bp, Homo sapiens
gatggcagtggctgc

SEQ ID NO: 491332 - DNA, 15 bp, Homo sapiens
atggcagtggctgcc

SEQ ID NO: 491333 - DNA, 15 bp, Homo sapiens
tggcagtggctgccc

SEQ ID NO: 491334 - DNA, 15 bp, Homo sapiens
ggcagtggctgccct

SEQ ID NO: 491335 - DNA, 15 bp, Homo sapiens
gcagtggctgccctt

SEQ ID NO: 491336 - DNA, 15 bp, Homo sapiens
cagtggctgcccttg

SEQ ID NO: 491337 - DNA, 15 bp, Homo sapiens
agtggctgcccttgc

SEQ ID NO: 491338 - DNA, 15 bp, Homo sapiens
gtggctgcccttgca

SEQ ID NO: 491339 - DNA, 15 bp, Homo sapiens
tggctgcccttgcaa

SEQ ID NO: 491340 - DNA, 15 bp, Homo sapiens
ggctgcccttgcaaa

SEQ ID NO: 491341 - DNA, 15 bp, Homo sapiens
gctgcccttgcaaag

SEQ ID NO: 491342 - DNA, 15 bp, Homo sapiens
ctgcccttgcaaagc

SEQ ID NO: 491343 - DNA, 15 bp, Homo sapiens
tgcccttgcaaagcc

SEQ ID NO: 491344 - DNA, 15 bp, Homo sapiens
gcccttgcaaagccc

SEQ ID NO: 491345 - DNA, 15 bp, Homo sapiens
cccttgcaaagcccg

SEQ ID NO: 491346 - DNA, 15 bp, Homo sapiens
ccttgcaaagcccgc

SEQ ID NO: 491347 - DNA, 15 bp, Homo sapiens
cttgcaaagcccgcc

SEQ ID NO: 491348 - DNA, 15 bp, Homo sapiens
ttgcaaagcccgcca

SEQ ID NO: 491349 - DNA, 15 bp, Homo sapiens
tgcaaagcccgccag

SEQ ID NO: 491350 - DNA, 15 bp, Homo sapiens
gcaaagcccgccaga

SEQ ID NO: 491351 - DNA, 15 bp, Homo sapiens
caaagcccgccagat

SEQ ID NO: 491352 - DNA, 15 bp, Homo sapiens
aaagcccgccagatc

SEQ ID NO: 491353 - DNA, 15 bp, Homo sapiens
aagcccgccagatcg

SEQ ID NO: 491354 - DNA, 15 bp, Homo sapiens
agcccgccagatcgt

SEQ ID NO: 491355 - DNA, 15 bp, Homo sapiens
gcccgccagatcgtc

SEQ ID NO: 491356 - DNA, 15 bp, Homo sapiens
cccgccagatcgtct

SEQ ID NO: 491357 - DNA, 15 bp, Homo sapiens
ccgccagatcgtctt

SEQ ID NO: 491358 - DNA, 15 bp, Homo sapiens
cgccagatcgtcttc

SEQ ID NO: 491359 - DNA, 15 bp, Homo sapiens
gccagatcgtcttca

SEQ ID NO: 491360 - DNA, 15 bp, Homo sapiens
ccagatcgtcttcac

SEQ ID NO: 491361 - DNA, 15 bp, Homo sapiens
cagatcgtcttcact

SEQ ID NO: 491362 - DNA, 15 bp, Homo sapiens
agatcgtcttcactg

SEQ ID NO: 491363 - DNA, 15 bp, Homo sapiens
gatcgtcttcactgt

SEQ ID NO: 491364 - DNA, 15 bp, Homo sapiens
atcgtcttcactgtt

SEQ ID NO: 491365 - DNA, 15 bp, Homo sapiens
tcgtcttcactgtta

SEQ ID NO: 491366 - DNA, 15 bp, Homo sapiens
cgtcttcactgttat

SEQ ID NO: 491367 - DNA, 15 bp, Homo sapiens
gtcttcactgttatg

SEQ ID NO: 491368 - DNA, 15 bp, Homo sapiens
tcttcactgttatgg

SEQ ID NO: 491369 - DNA, 15 bp, Homo sapiens
cttcactgttatggg

SEQ ID NO: 491370 - DNA, 15 bp, Homo sapiens
ttcactgttatgggc

SEQ ID NO: 491371 - DNA, 15 bp, Homo sapiens
tcactgttatgggct

SEQ ID NO: 491372 - DNA, 15 bp, Homo sapiens
cactgttatgggctc

SEQ ID NO: 491373 - DNA, 15 bp, Homo sapiens
actgttatgggctct

SEQ ID NO: 491374 - DNA, 15 bp, Homo sapiens
ctgttatgggctctg

SEQ ID NO: 491375 - DNA, 15 bp, Homo sapiens
tgttatgggctctgg

SEQ ID NO: 491376 - DNA, 15 bp, Homo sapiens
gttatgggctctgga

SEQ ID NO: 491377 - DNA, 15 bp, Homo sapiens
ttatgggctctggaa

SEQ ID NO: 491378 - DNA, 15 bp, Homo sapiens
tatgggctctggaac

SEQ ID NO: 491379 - DNA, 15 bp, Homo sapiens
atgggctctggaacc

SEQ ID NO: 491380 - DNA, 15 bp, Homo sapiens
tgggctctggaacca

SEQ ID NO: 491381 - DNA, 15 bp, Homo sapiens
gggctctggaaccaa

SEQ ID NO: 491382 - DNA, 15 bp, Homo sapiens
ggctctggaaccaaa

SEQ ID NO: 491383 - DNA, 15 bp, Homo sapiens
gctctggaaccaaaa

SEQ ID NO: 491384 - DNA, 15 bp, Homo sapiens
ctctggaaccaaaaa

SEQ ID NO: 491385 - DNA, 15 bp, Homo sapiens
tctggaaccaaaaag

SEQ ID NO: 491386 - DNA, 15 bp, Homo sapiens
ctggaaccaaaaagg

SEQ ID NO: 491387 - DNA, 15 bp, Homo sapiens
tggaaccaaaaagga

SEQ ID NO: 491388 - DNA, 15 bp, Homo sapiens
ggaaccaaaaaggaa

SEQ ID NO: 491389 - DNA, 15 bp, Homo sapiens
gaaccaaaaaggaat

SEQ ID NO: 491390 - DNA, 15 bp, Homo sapiens
aaccaaaaaggaatt

SEQ ID NO: 491391 - DNA, 15 bp, Homo sapiens
accaaaaaggaattg

SEQ ID NO: 491392 - DNA, 15 bp, Homo sapiens
ccaaaaaggaattga

SEQ ID NO: 491393 - DNA, 15 bp, Homo sapiens
caaaaaggaattgag

SEQ ID NO: 491394 - DNA, 15 bp, Homo sapiens
aaaaaggaattgagc

SEQ ID NO: 491395 - DNA, 15 bp, Homo sapiens
aaaaggaattgagct

SEQ ID NO: 491396 - DNA, 15 bp, Homo sapiens
aaaggaattgagcta

SEQ ID NO: 491397 - DNA, 15 bp, Homo sapiens
aaggaattgagctat

SEQ ID NO: 491398 - DNA, 15 bp, Homo sapiens
aggaattgagctatc

SEQ ID NO: 491399 - DNA, 15 bp, Homo sapiens
ggaattgagctatct

SEQ ID NO: 491400 - DNA, 15 bp, Homo sapiens
gaattgagctatctg

SEQ ID NO: 491401 - DNA, 15 bp, Homo sapiens
aattgagctatctgt

SEQ ID NO: 491402 - DNA, 15 bp, Homo sapiens
attgagctatctgtg

SEQ ID NO: 491403 - DNA, 15 bp, Homo sapiens
ttgagctatctgtgt

SEQ ID NO: 491404 - DNA, 15 bp, Homo sapiens
tgagctatctgtgtg

SEQ ID NO: 491405 - DNA, 15 bp, Homo sapiens
gagctatctgtgtgg

SEQ ID NO: 491406 - DNA, 15 bp, Homo sapiens
agctatctgtgtgga

SEQ ID NO: 491407 - DNA, 15 bp, Homo sapiens
gctatctgtgtggaa

SEQ ID NO: 491408 - DNA, 15 bp, Homo sapiens
ctatctgtgtggaaa

SEQ ID NO: 491409 - DNA, 15 bp, Homo sapiens
tatctgtgtggaaag

SEQ ID NO: 491410 - DNA, 15 bp, Homo sapiens
atctgtgtggaaagg

SEQ ID NO: 491411 - DNA, 15 bp, Homo sapiens
tctgtgtggaaagga

SEQ ID NO: 491412 - DNA, 15 bp, Homo sapiens
ctgtgtggaaaggag

SEQ ID NO: 491413 - DNA, 15 bp, Homo sapiens
tgtgtggaaaggaga

SEQ ID NO: 491414 - DNA, 15 bp, Homo sapiens
gtgtggaaaggagaa

SEQ ID NO: 491415 - DNA, 15 bp, Homo sapiens
tgtggaaaggagaat

SEQ ID NO: 491416 - DNA, 15 bp, Homo sapiens
gtggaaaggagaatt

SEQ ID NO: 491417 - DNA, 15 bp, Homo sapiens
tggaaaggagaatta

SEQ ID NO: 491418 - DNA, 15 bp, Homo sapiens
ggaaaggagaattag

SEQ ID NO: 491419 - DNA, 15 bp, Homo sapiens
gaaaggagaattaga

SEQ ID NO: 491420 - DNA, 15 bp, Homo sapiens
aaaggagaattagat

SEQ ID NO: 491421 - DNA, 15 bp, Homo sapiens
aaggagaattagatg

SEQ ID NO: 491422 - DNA, 15 bp, Homo sapiens
aggagaattagatgc

SEQ ID NO: 491423 - DNA, 15 bp, Homo sapiens
ggagaattagatgcc

SEQ ID NO: 491424 - DNA, 15 bp, Homo sapiens
gagaattagatgcca

SEQ ID NO: 491425 - DNA, 15 bp, Homo sapiens
agaattagatgccat

SEQ ID NO: 491426 - DNA, 15 bp, Homo sapiens
gaattagatgccata

SEQ ID NO: 491427 - DNA, 15 bp, Homo sapiens
aattagatgccatat

SEQ ID NO: 491428 - DNA, 15 bp, Homo sapiens
attagatgccatatt

SEQ ID NO: 491429 - DNA, 15 bp, Homo sapiens
ttagatgccatattc

SEQ ID NO: 491430 - DNA, 15 bp, Homo sapiens
tagatgccatattct

SEQ ID NO: 491431 - DNA, 15 bp, Homo sapiens
agatgccatattcta

SEQ ID NO: 491432 - DNA, 15 bp, Homo sapiens
gatgccatattctaa

SEQ ID NO: 491433 - DNA, 15 bp, Homo sapiens
atgccatattctaac

SEQ ID NO: 491434 - DNA, 15 bp, Homo sapiens
tgccatattctaact

SEQ ID NO: 491435 - DNA, 15 bp, Homo sapiens
gccatattctaactt

SEQ ID NO: 491436 - DNA, 15 bp, Homo sapiens
ccatattctaacttc

SEQ ID NO: 491437 - DNA, 15 bp, Homo sapiens
catattctaacttct

SEQ ID NO: 491438 - DNA, 15 bp, Homo sapiens
atattctaacttctc

SEQ ID NO: 491439 - DNA, 15 bp, Homo sapiens
tattctaacttctcc

SEQ ID NO: 491440 - DNA, 15 bp, Homo sapiens
attctaacttctccg

SEQ ID NO: 491441 - DNA, 15 bp, Homo sapiens
ttctaacttctccgt

SEQ ID NO: 491442 - DNA, 15 bp, Homo sapiens
tctaacttctccgtt

SEQ ID NO: 491443 - DNA, 15 bp, Homo sapiens
ctaacttctccgttg

SEQ ID NO: 491444 - DNA, 15 bp, Homo sapiens
taacttctccgttgt

SEQ ID NO: 491445 - DNA, 15 bp, Homo sapiens
aacttctccgttgtt

SEQ ID NO: 491446 - DNA, 15 bp, Homo sapiens
acttctccgttgttc

SEQ ID NO: 491447 - DNA, 15 bp, Homo sapiens
cttctccgttgttcc

SEQ ID NO: 491448 - DNA, 15 bp, Homo sapiens
ttctccgttgttcct

SEQ ID NO: 491449 - DNA, 15 bp, Homo sapiens
tctccgttgttccta

SEQ ID NO: 491450 - DNA, 15 bp, Homo sapiens
ctccgttgttcctaa

SEQ ID NO: 491451 - DNA, 15 bp, Homo sapiens
tccgttgttcctaac

SEQ ID NO: 491452 - DNA, 15 bp, Homo sapiens
ccgttgttcctaact

SEQ ID NO: 491453 - DNA, 15 bp, Homo sapiens
cgttgttcctaactg

SEQ ID NO: 491454 - DNA, 15 bp, Homo sapiens
gttgttcctaactgg

SEQ ID NO: 491455 - DNA, 15 bp, Homo sapiens
ttgttcctaactggg

SEQ ID NO: 491456 - DNA, 15 bp, Homo sapiens
tgttcctaactgggc

SEQ ID NO: 491457 - DNA, 15 bp, Homo sapiens
gttcctaactgggcc

SEQ ID NO: 491458 - DNA, 15 bp, Homo sapiens
ttcctaactgggccc

SEQ ID NO: 491459 - DNA, 15 bp, Homo sapiens
tcctaactgggccca

SEQ ID NO: 491460 - DNA, 15 bp, Homo sapiens
cctaactgggcccat

SEQ ID NO: 491461 - DNA, 15 bp, Homo sapiens
ctaactgggcccatc

SEQ ID NO: 491462 - DNA, 15 bp, Homo sapiens
taactgggcccatcc

SEQ ID NO: 491463 - DNA, 15 bp, Homo sapiens
aactgggcccatcca

SEQ ID NO: 491464 - DNA, 15 bp, Homo sapiens
actgggcccatccaa

SEQ ID NO: 491465 - DNA, 15 bp, Homo sapiens
ctgggcccatccaag

SEQ ID NO: 491466 - DNA, 15 bp, Homo sapiens
tgggcccatccaagg

SEQ ID NO: 491467 - DNA, 15 bp, Homo sapiens
gggcccatccaaggg

SEQ ID NO: 491468 - DNA, 15 bp, Homo sapiens
ggcccatccaaggga

SEQ ID NO: 491469 - DNA, 15 bp, Homo sapiens
gcccatccaagggac

SEQ ID NO: 491470 - DNA, 15 bp, Homo sapiens
cccatccaagggact

SEQ ID NO: 491471 - DNA, 15 bp, Homo sapiens
ccatccaagggacta

SEQ ID NO: 491472 - DNA, 15 bp, Homo sapiens
catccaagggactat

SEQ ID NO: 491473 - DNA, 15 bp, Homo sapiens
atccaagggactatt

SEQ ID NO: 491474 - DNA, 15 bp, Homo sapiens
tccaagggactatta

SEQ ID NO: 491475 - DNA, 15 bp, Homo sapiens
ccaagggactattat

SEQ ID NO: 491476 - DNA, 15 bp, Homo sapiens
caagggactattatt

SEQ ID NO: 491477 - DNA, 15 bp, Homo sapiens
aagggactattatta

SEQ ID NO: 491478 - DNA, 15 bp, Homo sapiens
gggactattattatc

SEQ ID NO: 491479 - DNA, 15 bp, Homo sapiens
ggactattattatcc

SEQ ID NO: 491480 - DNA, 15 bp, Homo sapiens
gactattattatccc

SEQ ID NO: 491481 - DNA, 15 bp, Homo sapiens
actattattatccca

SEQ ID NO: 491482 - DNA, 15 bp, Homo sapiens
ctattattatcccaa

SEQ ID NO: 491483 - DNA, 15 bp, Homo sapiens
tattattatcccaag

SEQ ID NO: 491484 - DNA, 15 bp, Homo sapiens
attattatcccaagt

SEQ ID NO: 491485 - DNA, 15 bp, Homo sapiens
ttattatcccaagtg

SEQ ID NO: 491486 - DNA, 15 bp, Homo sapiens
tattatcccaagtgt

SEQ ID NO: 491487 - DNA, 15 bp, Homo sapiens
attatcccaagtgtc

SEQ ID NO: 491488 - DNA, 15 bp, Homo sapiens
ttatcccaagtgtcc

SEQ ID NO: 491489 - DNA, 15 bp, Homo sapiens
tatcccaagtgtcca

SEQ ID NO: 491490 - DNA, 15 bp, Homo sapiens
atcccaagtgtccag

SEQ ID NO: 491491 - DNA, 15 bp, Homo sapiens
tcccaagtgtccaga

SEQ ID NO: 491492 - DNA, 15 bp, Homo sapiens
cccaagtgtccagaa

SEQ ID NO: 491493 - DNA, 15 bp, Homo sapiens
ccaagtgtccagaag

SEQ ID NO: 491494 - DNA, 15 bp, Homo sapiens
caagtgtccagaagg

SEQ ID NO: 491495 - DNA, 15 bp, Homo sapiens
aagtgtccagaagga

SEQ ID NO: 491496 - DNA, 15 bp, Homo sapiens
agtgtccagaaggac

SEQ ID NO: 491497 - DNA, 15 bp, Homo sapiens
gtgtccagaaggaca

SEQ ID NO: 491498 - DNA, 15 bp, Homo sapiens
tgtccagaaggacac

SEQ ID NO: 491499 - DNA, 15 bp, Homo sapiens
gtccagaaggacact

SEQ ID NO: 491500 - DNA, 15 bp, Homo sapiens
tccagaaggacactg

SEQ ID NO: 491501 - DNA, 15 bp, Homo sapiens
ccagaaggacactga

SEQ ID NO: 491502 - DNA, 15 bp, Homo sapiens
cagaaggacactgag

SEQ ID NO: 491503 - DNA, 15 bp, Homo sapiens
agaaggacactgagg

SEQ ID NO: 491504 - DNA, 15 bp, Homo sapiens
gaaggacactgagga

SEQ ID NO: 491505 - DNA, 15 bp, Homo sapiens
aaggacactgaggat

SEQ ID NO: 491506 - DNA, 15 bp, Homo sapiens
aggacactgaggatt

SEQ ID NO: 491507 - DNA, 15 bp, Homo sapiens
ggacactgaggatta

SEQ ID NO: 491508 - DNA, 15 bp, Homo sapiens
gacactgaggattag

SEQ ID NO: 491509 - DNA, 15 bp, Homo sapiens
acactgaggattagg

SEQ ID NO: 491510 - DNA, 15 bp, Homo sapiens
cactgaggattaggc

SEQ ID NO: 491511 - DNA, 15 bp, Homo sapiens
actgaggattaggcc

SEQ ID NO: 491512 - DNA, 15 bp, Homo sapiens
ctgaggattaggcca

SEQ ID NO: 491513 - DNA, 15 bp, Homo sapiens
tgaggattaggccag

SEQ ID NO: 491514 - DNA, 15 bp, Homo sapiens
gaggattaggccagc

SEQ ID NO: 491515 - DNA, 15 bp, Homo sapiens
aggattaggccagca

SEQ ID NO: 491516 - DNA, 15 bp, Homo sapiens
ggattaggccagcac

SEQ ID NO: 491517 - DNA, 15 bp, Homo sapiens
gattaggccagcact

SEQ ID NO: 491518 - DNA, 15 bp, Homo sapiens
attaggccagcactt

SEQ ID NO: 491519 - DNA, 15 bp, Homo sapiens
ttaggccagcacttt

SEQ ID NO: 491520 - DNA, 15 bp, Homo sapiens
taggccagcactttc

SEQ ID NO: 491521 - DNA, 15 bp, Homo sapiens
aggccagcactttcc

SEQ ID NO: 491522 - DNA, 15 bp, Homo sapiens
ggccagcactttcct

SEQ ID NO: 491523 - DNA, 15 bp, Homo sapiens
gccagcactttcctt

SEQ ID NO: 491524 - DNA, 15 bp, Homo sapiens
ccagcactttccttg

SEQ ID NO: 491525 - DNA, 15 bp, Homo sapiens
cagcactttccttga

SEQ ID NO: 491526 - DNA, 15 bp, Homo sapiens
agcactttccttgat

SEQ ID NO: 491527 - DNA, 15 bp, Homo sapiens
gcactttccttgatg

SEQ ID NO: 491528 - DNA, 15 bp, Homo sapiens
cactttccttgatgc

SEQ ID NO: 491529 - DNA, 15 bp, Homo sapiens
actttccttgatgca

SEQ ID NO: 491530 - DNA, 15 bp, Homo sapiens
ctttccttgatgcaa

SEQ ID NO: 491531 - DNA, 15 bp, Homo sapiens
tttccttgatgcaag

SEQ ID NO: 491532 - DNA, 15 bp, Homo sapiens
ttccttgatgcaagt

SEQ ID NO: 491533 - DNA, 15 bp, Homo sapiens
tccttgatgcaagta

SEQ ID NO: 491534 - DNA, 15 bp, Homo sapiens
ccttgatgcaagtac

SEQ ID NO: 491535 - DNA, 15 bp, Homo sapiens
cttgatgcaagtact

SEQ ID NO: 491536 - DNA, 15 bp, Homo sapiens
ttgatgcaagtactt

SEQ ID NO: 491537 - DNA, 15 bp, Homo sapiens
tgatgcaagtacttg

SEQ ID NO: 491538 - DNA, 15 bp, Homo sapiens
gatgcaagtacttgg

SEQ ID NO: 491539 - DNA, 15 bp, Homo sapiens
atgcaagtacttggc

SEQ ID NO: 491540 - DNA, 15 bp, Homo sapiens
tgcaagtacttggcc

SEQ ID NO: 491541 - DNA, 15 bp, Homo sapiens
gcaagtacttggcca

SEQ ID NO: 491542 - DNA, 15 bp, Homo sapiens
caagtacttggccac

SEQ ID NO: 491543 - DNA, 15 bp, Homo sapiens
aagtacttggccacc

SEQ ID NO: 491544 - DNA, 15 bp, Homo sapiens
agtacttggccacca

SEQ ID NO: 491545 - DNA, 15 bp, Homo sapiens
gtacttggccaccat

SEQ ID NO: 491546 - DNA, 15 bp, Homo sapiens
tacttggccaccatt

SEQ ID NO: 491547 - DNA, 15 bp, Homo sapiens
acttggccaccattt

SEQ ID NO: 491548 - DNA, 15 bp, Homo sapiens
cttggccaccatttt

SEQ ID NO: 491549 - DNA, 15 bp, Homo sapiens
ttggccaccattttc

SEQ ID NO: 491550 - DNA, 15 bp, Homo sapiens
tggccaccattttcc

SEQ ID NO: 491551 - DNA, 15 bp, Homo sapiens
ggccaccattttcct

SEQ ID NO: 491552 - DNA, 15 bp, Homo sapiens
gccaccattttcctg

SEQ ID NO: 491553 - DNA, 15 bp, Homo sapiens
ccaccattttcctgg

SEQ ID NO: 491554 - DNA, 15 bp, Homo sapiens
caccattttcctggg

SEQ ID NO: 491555 - DNA, 15 bp, Homo sapiens
accattttcctgggc

SEQ ID NO: 491556 - DNA, 15 bp, Homo sapiens
ccattttcctgggcg

SEQ ID NO: 491557 - DNA, 15 bp, Homo sapiens
cattttcctgggcgt

SEQ ID NO: 491558 - DNA, 15 bp, Homo sapiens
attttcctgggcgtt

SEQ ID NO: 491559 - DNA, 15 bp, Homo sapiens
ttttcctgggcgtta

SEQ ID NO: 491560 - DNA, 15 bp, Homo sapiens
tttcctgggcgttag

SEQ ID NO: 491561 - DNA, 15 bp, Homo sapiens
ttcctgggcgttagg

SEQ ID NO: 491562 - DNA, 15 bp, Homo sapiens
tcctgggcgttaggg

SEQ ID NO: 491563 - DNA, 15 bp, Homo sapiens
cctgggcgttagggt

SEQ ID NO: 491564 - DNA, 15 bp, Homo sapiens
ctgggcgttagggtc

SEQ ID NO: 491565 - DNA, 15 bp, Homo sapiens
tgggcgttagggtcc

SEQ ID NO: 491566 - DNA, 15 bp, Homo sapiens
gggcgttagggtcca

SEQ ID NO: 491567 - DNA, 15 bp, Homo sapiens
ggcgttagggtccag

SEQ ID NO: 491568 - DNA, 15 bp, Homo sapiens
gcgttagggtccagg

SEQ ID NO: 491569 - DNA, 15 bp, Homo sapiens
cgttagggtccaggg

SEQ ID NO: 491570 - DNA, 15 bp, Homo sapiens
gttagggtccagggt

SEQ ID NO: 491571 - DNA, 15 bp, Homo sapiens
ttagggtccagggtg

SEQ ID NO: 491572 - DNA, 15 bp, Homo sapiens
tagggtccagggtgt

SEQ ID NO: 491573 - DNA, 15 bp, Homo sapiens
agggtccagggtgtg

SEQ ID NO: 491574 - DNA, 15 bp, Homo sapiens
gggtccagggtgtgt

SEQ ID NO: 491575 - DNA, 15 bp, Homo sapiens
ggtccagggtgtgtc

SEQ ID NO: 491576 - DNA, 15 bp, Homo sapiens
gtccagggtgtgtca

SEQ ID NO: 491577 - DNA, 15 bp, Homo sapiens
tccagggtgtgtcaa

SEQ ID NO: 491578 - DNA, 15 bp, Homo sapiens
ccagggtgtgtcaag

SEQ ID NO: 491579 - DNA, 15 bp, Homo sapiens
cagggtgtgtcaagg

SEQ ID NO: 491580 - DNA, 15 bp, Homo sapiens
agggtgtgtcaaggg

SEQ ID NO: 491581 - DNA, 15 bp, Homo sapiens
gggtgtgtcaagggt

SEQ ID NO: 491582 - DNA, 15 bp, Homo sapiens
ggtgtgtcaagggtg

SEQ ID NO: 491583 - DNA, 15 bp, Homo sapiens
gtgtgtcaagggtgg

SEQ ID NO: 491584 - DNA, 15 bp, Homo sapiens
tgtgtcaagggtggg

SEQ ID NO: 491585 - DNA, 15 bp, Homo sapiens
gtgtcaagggtgggt

SEQ ID NO: 491586 - DNA, 15 bp, Homo sapiens
tgtcaagggtgggtc

SEQ ID NO: 491587 - DNA, 15 bp, Homo sapiens
gtcaagggtgggtca

SEQ ID NO: 491588 - DNA, 15 bp, Homo sapiens
tcaagggtgggtcaa

SEQ ID NO: 491589 - DNA, 15 bp, Homo sapiens
caagggtgggtcaag

SEQ ID NO: 491590 - DNA, 15 bp, Homo sapiens
aagggtgggtcaaga

SEQ ID NO: 491591 - DNA, 15 bp, Homo sapiens
agggtgggtcaagag

SEQ ID NO: 491592 - DNA, 15 bp, Homo sapiens
gggtgggtcaagaga

SEQ ID NO: 491593 - DNA, 15 bp, Homo sapiens
ggtgggtcaagagag

SEQ ID NO: 491594 - DNA, 15 bp, Homo sapiens
gtgggtcaagagagg

SEQ ID NO: 491595 - DNA, 15 bp, Homo sapiens
tgggtcaagagaggc

SEQ ID NO: 491596 - DNA, 15 bp, Homo sapiens
gggtcaagagaggca

SEQ ID NO: 491597 - DNA, 15 bp, Homo sapiens
ggtcaagagaggcag

SEQ ID NO: 491598 - DNA, 15 bp, Homo sapiens
gtcaagagaggcaga

SEQ ID NO: 491599 - DNA, 15 bp, Homo sapiens
tcaagagaggcagaa

SEQ ID NO: 491600 - DNA, 15 bp, Homo sapiens
caagagaggcagaaa

SEQ ID NO: 491601 - DNA, 15 bp, Homo sapiens
aagagaggcagaaac

SEQ ID NO: 491602 - DNA, 15 bp, Homo sapiens
agagaggcagaaacc

SEQ ID NO: 491603 - DNA, 15 bp, Homo sapiens
gagaggcagaaacca

SEQ ID NO: 491604 - DNA, 15 bp, Homo sapiens
agaggcagaaaccaa

SEQ ID NO: 491605 - DNA, 15 bp, Homo sapiens
gaggcagaaaccaaa

SEQ ID NO: 491606 - DNA, 15 bp, Homo sapiens
aggcagaaaccaaag

SEQ ID NO: 491607 - DNA, 15 bp, Homo sapiens
ggcagaaaccaaaga

SEQ ID NO: 491608 - DNA, 15 bp, Homo sapiens
gcagaaaccaaagac

SEQ ID NO: 491609 - DNA, 15 bp, Homo sapiens
cagaaaccaaagact

SEQ ID NO: 491610 - DNA, 15 bp, Homo sapiens
agaaaccaaagactt

SEQ ID NO: 491611 - DNA, 15 bp, Homo sapiens
gaaaccaaagactta

SEQ ID NO: 491612 - DNA, 15 bp, Homo sapiens
aaaccaaagacttat

SEQ ID NO: 491613 - DNA, 15 bp, Homo sapiens
aaccaaagacttatg

SEQ ID NO: 491614 - DNA, 15 bp, Homo sapiens
accaaagacttatgc

SEQ ID NO: 491615 - DNA, 15 bp, Homo sapiens
ccaaagacttatgcc

SEQ ID NO: 491616 - DNA, 15 bp, Homo sapiens
caaagacttatgcct

SEQ ID NO: 491617 - DNA, 15 bp, Homo sapiens
aaagacttatgcctt

SEQ ID NO: 491618 - DNA, 15 bp, Homo sapiens
aagacttatgccttc

SEQ ID NO: 491619 - DNA, 15 bp, Homo sapiens
agacttatgccttca

SEQ ID NO: 491620 - DNA, 15 bp, Homo sapiens
gacttatgccttcag

SEQ ID NO: 491621 - DNA, 15 bp, Homo sapiens
acttatgccttcagt

SEQ ID NO: 491622 - DNA, 15 bp, Homo sapiens
cttatgccttcagtg

SEQ ID NO: 491623 - DNA, 15 bp, Homo sapiens
ttatgccttcagtgg

SEQ ID NO: 491624 - DNA, 15 bp, Homo sapiens
tatgccttcagtggt

SEQ ID NO: 491625 - DNA, 15 bp, Homo sapiens
atgccttcagtggtc

SEQ ID NO: 491626 - DNA, 15 bp, Homo sapiens
tgccttcagtggtcc

SEQ ID NO: 491627 - DNA, 15 bp, Homo sapiens
gccttcagtggtccc

SEQ ID NO: 491628 - DNA, 15 bp, Homo sapiens
ccttcagtggtccct

SEQ ID NO: 491629 - DNA, 15 bp, Homo sapiens
cttcagtggtccctt

SEQ ID NO: 491630 - DNA, 15 bp, Homo sapiens
ttcagtggtcccttg

SEQ ID NO: 491631 - DNA, 15 bp, Homo sapiens
tcagtggtcccttgg

SEQ ID NO: 491632 - DNA, 15 bp, Homo sapiens
cagtggtcccttggt

SEQ ID NO: 491633 - DNA, 15 bp, Homo sapiens
agtggtcccttggtc

SEQ ID NO: 491634 - DNA, 15 bp, Homo sapiens
gtggtcccttggtca

SEQ ID NO: 491635 - DNA, 15 bp, Homo sapiens
tggtcccttggtcag

SEQ ID NO: 491636 - DNA, 15 bp, Homo sapiens
ggtcccttggtcaga

SEQ ID NO: 491637 - DNA, 15 bp, Homo sapiens
gtcccttggtcagaa

SEQ ID NO: 491638 - DNA, 15 bp, Homo sapiens
tcccttggtcagaat

SEQ ID NO: 491639 - DNA, 15 bp, Homo sapiens
cccttggtcagaatt

SEQ ID NO: 491640 - DNA, 15 bp, Homo sapiens
ccttggtcagaatta

SEQ ID NO: 491641 - DNA, 15 bp, Homo sapiens
cttggtcagaattag

SEQ ID NO: 491642 - DNA, 15 bp, Homo sapiens
ttggtcagaattagt

SEQ ID NO: 491643 - DNA, 15 bp, Homo sapiens
tggtcagaattagta

SEQ ID NO: 491644 - DNA, 15 bp, Homo sapiens
ggtcagaattagtac

SEQ ID NO: 491645 - DNA, 15 bp, Homo sapiens
gtcagaattagtact

SEQ ID NO: 491646 - DNA, 15 bp, Homo sapiens
tcagaattagtactc

SEQ ID NO: 491647 - DNA, 15 bp, Homo sapiens
cagaattagtactca

SEQ ID NO: 491648 - DNA, 15 bp, Homo sapiens
agaattagtactcag

SEQ ID NO: 491649 - DNA, 15 bp, Homo sapiens
gaattagtactcagc

SEQ ID NO: 491650 - DNA, 15 bp, Homo sapiens
aattagtactcagca

SEQ ID NO: 491651 - DNA, 15 bp, Homo sapiens
attagtactcagcaa

SEQ ID NO: 491652 - DNA, 15 bp, Homo sapiens
ttagtactcagcaaa

SEQ ID NO: 491653 - DNA, 15 bp, Homo sapiens
tagtactcagcaaag

SEQ ID NO: 491654 - DNA, 15 bp, Homo sapiens
agtactcagcaaagt

SEQ ID NO: 491655 - DNA, 15 bp, Homo sapiens
gtactcagcaaagta

SEQ ID NO: 491656 - DNA, 15 bp, Homo sapiens
tactcagcaaagtaa

SEQ ID NO: 491657 - DNA, 15 bp, Homo sapiens
actcagcaaagtaag

SEQ ID NO: 491658 - DNA, 15 bp, Homo sapiens
ctcagcaaagtaagt

SEQ ID NO: 491659 - DNA, 15 bp, Homo sapiens
tcagcaaagtaagta

SEQ ID NO: 491660 - DNA, 15 bp, Homo sapiens
cagcaaagtaagtag

SEQ ID NO: 491661 - DNA, 15 bp, Homo sapiens
agcaaagtaagtaga

SEQ ID NO: 491662 - DNA, 15 bp, Homo sapiens
gcaaagtaagtagaa

SEQ ID NO: 491663 - DNA, 15 bp, Homo sapiens
caaagtaagtagaac

SEQ ID NO: 491664 - DNA, 15 bp, Homo sapiens
aaagtaagtagaaca

SEQ ID NO: 491665 - DNA, 15 bp, Homo sapiens
aagtaagtagaacat

SEQ ID NO: 491666 - DNA, 15 bp, Homo sapiens
agtaagtagaacatg

SEQ ID NO: 491667 - DNA, 15 bp, Homo sapiens
gtaagtagaacatgc

SEQ ID NO: 491668 - DNA, 15 bp, Homo sapiens
taagtagaacatgct

SEQ ID NO: 491669 - DNA, 15 bp, Homo sapiens
aagtagaacatgctc

SEQ ID NO: 491670 - DNA, 15 bp, Homo sapiens
agtagaacatgctct

SEQ ID NO: 491671 - DNA, 15 bp, Homo sapiens
gtagaacatgctctg

SEQ ID NO: 491672 - DNA, 15 bp, Homo sapiens
tagaacatgctctgt

SEQ ID NO: 491673 - DNA, 15 bp, Homo sapiens
agaacatgctctgtt

SEQ ID NO: 491674 - DNA, 15 bp, Homo sapiens
gaacatgctctgttc

SEQ ID NO: 491675 - DNA, 15 bp, Homo sapiens
aacatgctctgttct

SEQ ID NO: 491676 - DNA, 15 bp, Homo sapiens
acatgctctgttctg

SEQ ID NO: 491677 - DNA, 15 bp, Homo sapiens
catgctctgttctga

SEQ ID NO: 491678 - DNA, 15 bp, Homo sapiens
atgctctgttctgat

SEQ ID NO: 491679 - DNA, 15 bp, Homo sapiens
tgctctgttctgata

SEQ ID NO: 491680 - DNA, 15 bp, Homo sapiens
gctctgttctgatac

SEQ ID NO: 491681 - DNA, 15 bp, Homo sapiens
ctctgttctgataca

SEQ ID NO: 491682 - DNA, 15 bp, Homo sapiens
tctgttctgatacat

SEQ ID NO: 491683 - DNA, 15 bp, Homo sapiens
ctgttctgatacata

SEQ ID NO: 491684 - DNA, 15 bp, Homo sapiens
tgttctgatacataa

SEQ ID NO: 491685 - DNA, 15 bp, Homo sapiens
gttctgatacataaa

SEQ ID NO: 491686 - DNA, 15 bp, Homo sapiens
ttctgatacataaac

SEQ ID NO: 491687 - DNA, 15 bp, Homo sapiens
tctgatacataaacc

SEQ ID NO: 491688 - DNA, 15 bp, Homo sapiens
ctgatacataaacca

SEQ ID NO: 491689 - DNA, 15 bp, Homo sapiens
tgatacataaaccaa

SEQ ID NO: 491690 - DNA, 15 bp, Homo sapiens
gatacataaaccaaa

SEQ ID NO: 491691 - DNA, 15 bp, Homo sapiens
atacataaaccaaat

SEQ ID NO: 491692 - DNA, 15 bp, Homo sapiens
tacataaaccaaata

SEQ ID NO: 491693 - DNA, 15 bp, Homo sapiens
acataaaccaaatac

SEQ ID NO: 491694 - DNA, 15 bp, Homo sapiens
cataaaccaaataca

SEQ ID NO: 491695 - DNA, 15 bp, Homo sapiens
ataaaccaaatacac

SEQ ID NO: 491696 - DNA, 15 bp, Homo sapiens
taaaccaaatacaca

SEQ ID NO: 491697 - DNA, 15 bp, Homo sapiens
aaaccaaatacacag

SEQ ID NO: 491698 - DNA, 15 bp, Homo sapiens
aaccaaatacacagt

SEQ ID NO: 491699 - DNA, 15 bp, Homo sapiens
accaaatacacagta

SEQ ID NO: 491700 - DNA, 15 bp, Homo sapiens
ccaaatacacagtat

SEQ ID NO: 491701 - DNA, 15 bp, Homo sapiens
caaatacacagtatg

SEQ ID NO: 491702 - DNA, 15 bp, Homo sapiens
aaatacacagtatga

SEQ ID NO: 491703 - DNA, 15 bp, Homo sapiens
aatacacagtatgat

SEQ ID NO: 491704 - DNA, 15 bp, Homo sapiens
atacacagtatgatt

SEQ ID NO: 491705 - DNA, 15 bp, Homo sapiens
tacacagtatgattt

SEQ ID NO: 491706 - DNA, 15 bp, Homo sapiens
acacagtatgattta

SEQ ID NO: 491707 - DNA, 15 bp, Homo sapiens
cacagtatgatttaa

SEQ ID NO: 491708 - DNA, 15 bp, Homo sapiens
acagtatgatttaaa

SEQ ID NO: 491709 - DNA, 15 bp, Homo sapiens
cagtatgatttaaat

SEQ ID NO: 491710 - DNA, 15 bp, Homo sapiens
agtatgatttaaata

SEQ ID NO: 491711 - DNA, 15 bp, Homo sapiens
gtatgatttaaatag

SEQ ID NO: 491712 - DNA, 15 bp, Homo sapiens
tatgatttaaatagg

SEQ ID NO: 491713 - DNA, 15 bp, Homo sapiens
atgatttaaatagga

SEQ ID NO: 491714 - DNA, 15 bp, Homo sapiens
tgatttaaataggaa

SEQ ID NO: 491715 - DNA, 15 bp, Homo sapiens
gatttaaataggaaa

SEQ ID NO: 491716 - DNA, 15 bp, Homo sapiens
atttaaataggaaat

SEQ ID NO: 491717 - DNA, 15 bp, Homo sapiens
tttaaataggaaatg

SEQ ID NO: 491718 - DNA, 15 bp, Homo sapiens
ttaaataggaaatga

SEQ ID NO: 491719 - DNA, 15 bp, Homo sapiens
taaataggaaatgag

SEQ ID NO: 491720 - DNA, 15 bp, Homo sapiens
aaataggaaatgaga

SEQ ID NO: 491721 - DNA, 15 bp, Homo sapiens
aataggaaatgagat

SEQ ID NO: 491722 - DNA, 15 bp, Homo sapiens
ataggaaatgagatt

SEQ ID NO: 491723 - DNA, 15 bp, Homo sapiens
taggaaatgagattt

SEQ ID NO: 491724 - DNA, 15 bp, Homo sapiens
aggaaatgagatttt

SEQ ID NO: 491725 - DNA, 15 bp, Homo sapiens
ggaaatgagattttt

SEQ ID NO: 491726 - DNA, 15 bp, Homo sapiens
gaaatgagatttttt

SEQ ID NO: 491727 - DNA, 15 bp, Homo sapiens
aaatgagattttttg

SEQ ID NO: 491728 - DNA, 15 bp, Homo sapiens
aatgagattttttgc

SEQ ID NO: 491729 - DNA, 15 bp, Homo sapiens
atgagattttttgca

SEQ ID NO: 491730 - DNA, 15 bp, Homo sapiens
tgagattttttgcaa

SEQ ID NO: 491731 - DNA, 15 bp, Homo sapiens
gagattttttgcaag

SEQ ID NO: 491732 - DNA, 15 bp, Homo sapiens
agattttttgcaaga

SEQ ID NO: 491733 - DNA, 15 bp, Homo sapiens
gattttttgcaagac

SEQ ID NO: 491734 - DNA, 15 bp, Homo sapiens
attttttgcaagact

SEQ ID NO: 491735 - DNA, 15 bp, Homo sapiens
ttttttgcaagacta

SEQ ID NO: 491736 - DNA, 15 bp, Homo sapiens
tttttgcaagactaa

SEQ ID NO: 491737 - DNA, 15 bp, Homo sapiens
ttttgcaagactaag

SEQ ID NO: 491738 - DNA, 15 bp, Homo sapiens
tttgcaagactaagt

SEQ ID NO: 491739 - DNA, 15 bp, Homo sapiens
ttgcaagactaagtg

SEQ ID NO: 491740 - DNA, 15 bp, Homo sapiens
tgcaagactaagtgc

SEQ ID NO: 491741 - DNA, 15 bp, Homo sapiens
gcaagactaagtgct

SEQ ID NO: 491742 - DNA, 15 bp, Homo sapiens
caagactaagtgctc

SEQ ID NO: 491743 - DNA, 15 bp, Homo sapiens
aagactaagtgctca

SEQ ID NO: 491744 - DNA, 15 bp, Homo sapiens
agactaagtgctcag

SEQ ID NO: 491745 - DNA, 15 bp, Homo sapiens
gactaagtgctcagt

SEQ ID NO: 491746 - DNA, 15 bp, Homo sapiens
actaagtgctcagtg

SEQ ID NO: 491747 - DNA, 15 bp, Homo sapiens
ctaagtgctcagtga

SEQ ID NO: 491748 - DNA, 15 bp, Homo sapiens
taagtgctcagtgaa

SEQ ID NO: 491749 - DNA, 15 bp, Homo sapiens
aagtgctcagtgaat

SEQ ID NO: 491750 - DNA, 15 bp, Homo sapiens
agtgctcagtgaatg

SEQ ID NO: 491751 - DNA, 15 bp, Homo sapiens
gtgctcagtgaatgc

SEQ ID NO: 491752 - DNA, 15 bp, Homo sapiens
tcagtgaatgcttta

SEQ ID NO: 491753 - DNA, 15 bp, Homo sapiens
cagtgaatgctttag

SEQ ID NO: 491754 - DNA, 15 bp, Homo sapiens
agtgaatgctttagt

SEQ ID NO: 491755 - DNA, 15 bp, Homo sapiens
gtgaatgctttagtg

SEQ ID NO: 491756 - DNA, 15 bp, Homo sapiens
tgaatgctttagtgt

SEQ ID NO: 491757 - DNA, 15 bp, Homo sapiens
gaatgctttagtgta

SEQ ID NO: 491758 - DNA, 15 bp, Homo sapiens
aatgctttagtgtat

SEQ ID NO: 491759 - DNA, 15 bp, Homo sapiens
atgctttagtgtatg

SEQ ID NO: 491760 - DNA, 15 bp, Homo sapiens
tgctttagtgtatgc

SEQ ID NO: 491761 - DNA, 15 bp, Homo sapiens
gctttagtgtatgca

SEQ ID NO: 491762 - DNA, 15 bp, Homo sapiens
ctttagtgtatgcac

SEQ ID NO: 491763 - DNA, 15 bp, Homo sapiens
tttagtgtatgcact

SEQ ID NO: 491764 - DNA, 15 bp, Homo sapiens
ttagtgtatgcacta

SEQ ID NO: 491765 - DNA, 15 bp, Homo sapiens
tagtgtatgcactaa

SEQ ID NO: 491766 - DNA, 15 bp, Homo sapiens
agtgtatgcactaaa

SEQ ID NO: 491767 - DNA, 15 bp, Homo sapiens
gtgtatgcactaaat

SEQ ID NO: 491768 - DNA, 15 bp, Homo sapiens
tgtatgcactaaatc

SEQ ID NO: 491769 - DNA, 15 bp, Homo sapiens
gtatgcactaaatct

SEQ ID NO: 491770 - DNA, 15 bp, Homo sapiens
tatgcactaaatctt

SEQ ID NO: 491771 - DNA, 15 bp, Homo sapiens
atgcactaaatctta

SEQ ID NO: 491772 - DNA, 15 bp, Homo sapiens
tgcactaaatcttaa

SEQ ID NO: 491773 - DNA, 15 bp, Homo sapiens
gcactaaatcttaaa

SEQ ID NO: 491774 - DNA, 15 bp, Homo sapiens
cactaaatcttaaat

SEQ ID NO: 491775 - DNA, 15 bp, Homo sapiens
actaaatcttaaatc

SEQ ID NO: 491776 - DNA, 15 bp, Homo sapiens
ctaaatcttaaatca

SEQ ID NO: 491777 - DNA, 15 bp, Homo sapiens
taaatcttaaatcac

SEQ ID NO: 491778 - DNA, 15 bp, Homo sapiens
aaatcttaaatcaca

SEQ ID NO: 491779 - DNA, 15 bp, Homo sapiens
atcttaaatcacatg

SEQ ID NO: 491780 - DNA, 15 bp, Homo sapiens
tcttaaatcacatgg

SEQ ID NO: 491781 - DNA, 15 bp, Homo sapiens
cttaaatcacatggg

SEQ ID NO: 491782 - DNA, 15 bp, Homo sapiens
ttaaatcacatggga

SEQ ID NO: 491783 - DNA, 15 bp, Homo sapiens
taaatcacatgggat

SEQ ID NO: 491784 - DNA, 15 bp, Homo sapiens
aaatcacatgggata

SEQ ID NO: 491785 - DNA, 15 bp, Homo sapiens
aatcacatgggatat

SEQ ID NO: 491786 - DNA, 15 bp, Homo sapiens
atcacatgggatatg

SEQ ID NO: 491787 - DNA, 15 bp, Homo sapiens
tcacatgggatatga

SEQ ID NO: 491788 - DNA, 15 bp, Homo sapiens
cacatgggatatgag

SEQ ID NO: 491789 - DNA, 15 bp, Homo sapiens
acatgggatatgaga

SEQ ID NO: 491790 - DNA, 15 bp, Homo sapiens
catgggatatgagaa

SEQ ID NO: 491791 - DNA, 15 bp, Homo sapiens
atgggatatgagaaa

SEQ ID NO: 491792 - DNA, 15 bp, Homo sapiens
tgggatatgagaaac

SEQ ID NO: 491793 - DNA, 15 bp, Homo sapiens
gggatatgagaaact

SEQ ID NO: 491794 - DNA, 15 bp, Homo sapiens
ggatatgagaaacta

SEQ ID NO: 491795 - DNA, 15 bp, Homo sapiens
gatatgagaaactaa

SEQ ID NO: 491796 - DNA, 15 bp, Homo sapiens
atatgagaaactaac

SEQ ID NO: 491797 - DNA, 15 bp, Homo sapiens
tatgagaaactaacc

SEQ ID NO: 491798 - DNA, 15 bp, Homo sapiens
atgagaaactaacca

SEQ ID NO: 491799 - DNA, 15 bp, Homo sapiens
tgagaaactaaccag

SEQ ID NO: 491800 - DNA, 15 bp, Homo sapiens
gagaaactaaccagg

SEQ ID NO: 491801 - DNA, 15 bp, Homo sapiens
agaaactaaccagga

SEQ ID NO: 491802 - DNA, 15 bp, Homo sapiens
gaaactaaccaggaa

SEQ ID NO: 491803 - DNA, 15 bp, Homo sapiens
aaactaaccaggaaa

SEQ ID NO: 491804 - DNA, 15 bp, Homo sapiens
aactaaccaggaaaa

SEQ ID NO: 491805 - DNA, 15 bp, Homo sapiens
actaaccaggaaaac

SEQ ID NO: 491806 - DNA, 15 bp, Homo sapiens
ctaaccaggaaaact

SEQ ID NO: 491807 - DNA, 15 bp, Homo sapiens
taaccaggaaaacta

SEQ ID NO: 491808 - DNA, 15 bp, Homo sapiens
aaccaggaaaactag

SEQ ID NO: 491809 - DNA, 15 bp, Homo sapiens
accaggaaaactagc

SEQ ID NO: 491810 - DNA, 15 bp, Homo sapiens
ccaggaaaactagcc

SEQ ID NO: 491811 - DNA, 15 bp, Homo sapiens
caggaaaactagccc

SEQ ID NO: 491812 - DNA, 15 bp, Homo sapiens
aggaaaactagccct

SEQ ID NO: 491813 - DNA, 15 bp, Homo sapiens
ggaaaactagccctc

SEQ ID NO: 491814 - DNA, 15 bp, Homo sapiens
gaaaactagccctca

SEQ ID NO: 491815 - DNA, 15 bp, Homo sapiens
aaaactagccctcat

SEQ ID NO: 491816 - DNA, 15 bp, Homo sapiens
aaactagccctcatt

SEQ ID NO: 491817 - DNA, 15 bp, Homo sapiens
aactagccctcattg

SEQ ID NO: 491818 - DNA, 15 bp, Homo sapiens
actagccctcattga

SEQ ID NO: 491819 - DNA, 15 bp, Homo sapiens
ctagccctcattgaa

SEQ ID NO: 491820 - DNA, 15 bp, Homo sapiens
tagccctcattgaag

SEQ ID NO: 491821 - DNA, 15 bp, Homo sapiens
agccctcattgaagc

SEQ ID NO: 491822 - DNA, 15 bp, Homo sapiens
gccctcattgaagca

SEQ ID NO: 491823 - DNA, 15 bp, Homo sapiens
ccctcattgaagcat

SEQ ID NO: 491824 - DNA, 15 bp, Homo sapiens
cctcattgaagcatt

SEQ ID NO: 491825 - DNA, 15 bp, Homo sapiens
ctcattgaagcatta

SEQ ID NO: 491826 - DNA, 15 bp, Homo sapiens
tcattgaagcattaa

SEQ ID NO: 491827 - DNA, 15 bp, Homo sapiens
cattgaagcattaag

SEQ ID NO: 491828 - DNA, 15 bp, Homo sapiens
attgaagcattaagc

SEQ ID NO: 491829 - DNA, 15 bp, Homo sapiens
ttgaagcattaagcc

SEQ ID NO: 491830 - DNA, 15 bp, Homo sapiens
tgaagcattaagcca

SEQ ID NO: 491831 - DNA, 15 bp, Homo sapiens
gaagcattaagccag

SEQ ID NO: 491832 - DNA, 15 bp, Homo sapiens
aagcattaagccagg

SEQ ID NO: 491833 - DNA, 15 bp, Homo sapiens
agcattaagccagga

SEQ ID NO: 491834 - DNA, 15 bp, Homo sapiens
gcattaagccaggaa

SEQ ID NO: 491835 - DNA, 15 bp, Homo sapiens
cattaagccaggaaa

SEQ ID NO: 491836 - DNA, 15 bp, Homo sapiens
attaagccaggaaaa

SEQ ID NO: 491837 - DNA, 15 bp, Homo sapiens
ttaagccaggaaaaa

SEQ ID NO: 491838 - DNA, 15 bp, Homo sapiens
taagccaggaaaaaa

SEQ ID NO: 491839 - DNA, 15 bp, Homo sapiens
aagccaggaaaaaaa

SEQ ID NO: 491840 - DNA, 15 bp, Homo sapiens
agccaggaaaaaaaa

SEQ ID NO: 491841 - DNA, 15 bp, Homo sapiens
gccaggaaaaaaaaa

SEQ ID NO: 491842 - DNA, 15 bp, Homo sapiens
ccaggaaaaaaaaaa

SEQ ID NO: 491843 - DNA, 15 bp, Homo sapiens
caggaaaaaaaaaat

SEQ ID NO: 491844 - DNA, 15 bp, Homo sapiens
ggaaaaaaaaaatgt

SEQ ID NO: 491845 - DNA, 15 bp, Homo sapiens
gaaaaaaaaaatgtg

SEQ ID NO: 491846 - DNA, 15 bp, Homo sapiens
aaaaaaaaaatgtgt

SEQ ID NO: 491847 - DNA, 15 bp, Homo sapiens
aaaaaaaaatgtgtt

SEQ ID NO: 491848 - DNA, 15 bp, Homo sapiens
aaaaaaaatgtgttt

SEQ ID NO: 491849 - DNA, 15 bp, Homo sapiens
aaaaaaatgtgtttc

SEQ ID NO: 491850 - DNA, 15 bp, Homo sapiens
aaaaaatgtgtttct

SEQ ID NO: 491851 - DNA, 15 bp, Homo sapiens
aaaaatgtgtttctt

SEQ ID NO: 491852 - DNA, 15 bp, Homo sapiens
aaaatgtgtttcttg

SEQ ID NO: 491853 - DNA, 15 bp, Homo sapiens
aaatgtgtttcttgt

SEQ ID NO: 491854 - DNA, 15 bp, Homo sapiens
aatgtgtttcttgtt

SEQ ID NO: 491855 - DNA, 15 bp, Homo sapiens
atgtgtttcttgttt

SEQ ID NO: 491856 - DNA, 15 bp, Homo sapiens
tgtgtttcttgtttt

SEQ ID NO: 491857 - DNA, 15 bp, Homo sapiens
gtgtttcttgttttt

SEQ ID NO: 491858 - DNA, 15 bp, Homo sapiens
tgtttcttgtttttc

SEQ ID NO: 491859 - DNA, 15 bp, Homo sapiens
gtttcttgtttttcc

SEQ ID NO: 491860 - DNA, 15 bp, Homo sapiens
tttcttgtttttcct

SEQ ID NO: 491861 - DNA, 15 bp, Homo sapiens
ttcttgtttttccta

SEQ ID NO: 491862 - DNA, 15 bp, Homo sapiens
tcttgtttttcctat

SEQ ID NO: 491863 - DNA, 15 bp, Homo sapiens
cttgtttttcctatt

SEQ ID NO: 491864 - DNA, 15 bp, Homo sapiens
ttgtttttcctatta

SEQ ID NO: 491865 - DNA, 15 bp, Homo sapiens
tgtttttcctattag

SEQ ID NO: 491866 - DNA, 15 bp, Homo sapiens
gtttttcctattagc

SEQ ID NO: 491867 - DNA, 15 bp, Homo sapiens
tttttcctattagca

SEQ ID NO: 491868 - DNA, 15 bp, Homo sapiens
ttttcctattagcat

SEQ ID NO: 491869 - DNA, 15 bp, Homo sapiens
tttcctattagcatc

SEQ ID NO: 491870 - DNA, 15 bp, Homo sapiens
ttcctattagcatcc

SEQ ID NO: 491871 - DNA, 15 bp, Homo sapiens
tcctattagcatcca

SEQ ID NO: 491872 - DNA, 15 bp, Homo sapiens
cctattagcatccat

SEQ ID NO: 491873 - DNA, 15 bp, Homo sapiens
ctattagcatccatt

SEQ ID NO: 491874 - DNA, 15 bp, Homo sapiens
tattagcatccattt

SEQ ID NO: 491875 - DNA, 15 bp, Homo sapiens
attagcatccattta

SEQ ID NO: 491876 - DNA, 15 bp, Homo sapiens
ttagcatccatttaa

SEQ ID NO: 491877 - DNA, 15 bp, Homo sapiens
tagcatccatttaac

SEQ ID NO: 491878 - DNA, 15 bp, Homo sapiens
agcatccatttaaca

SEQ ID NO: 491879 - DNA, 15 bp, Homo sapiens
gcatccatttaacaa

SEQ ID NO: 491880 - DNA, 15 bp, Homo sapiens
catccatttaacaac

SEQ ID NO: 491881 - DNA, 15 bp, Homo sapiens
atccatttaacaact

SEQ ID NO: 491882 - DNA, 15 bp, Homo sapiens
tccatttaacaactg

SEQ ID NO: 491883 - DNA, 15 bp, Homo sapiens
ccatttaacaactgg

SEQ ID NO: 491884 - DNA, 15 bp, Homo sapiens
catttaacaactggg

SEQ ID NO: 491885 - DNA, 15 bp, Homo sapiens
atttaacaactgggc

SEQ ID NO: 491886 - DNA, 15 bp, Homo sapiens
tttaacaactgggct

SEQ ID NO: 491887 - DNA, 15 bp, Homo sapiens
ttaacaactgggcta

SEQ ID NO: 491888 - DNA, 15 bp, Homo sapiens
taacaactgggctat

SEQ ID NO: 491889 - DNA, 15 bp, Homo sapiens
aacaactgggctatt

SEQ ID NO: 491890 - DNA, 15 bp, Homo sapiens
acaactgggctatta

SEQ ID NO: 491891 - DNA, 15 bp, Homo sapiens
caactgggctattat

SEQ ID NO: 491892 - DNA, 15 bp, Homo sapiens
aactgggctattatt

SEQ ID NO: 491893 - DNA, 15 bp, Homo sapiens
actgggctattatta

SEQ ID NO: 491894 - DNA, 15 bp, Homo sapiens
ctgggctattattac

SEQ ID NO: 491895 - DNA, 15 bp, Homo sapiens
tgggctattattacc

SEQ ID NO: 491896 - DNA, 15 bp, Homo sapiens
gggctattattaccc

SEQ ID NO: 491897 - DNA, 15 bp, Homo sapiens
ggctattattaccct

SEQ ID NO: 491898 - DNA, 15 bp, Homo sapiens
gctattattacccta

SEQ ID NO: 491899 - DNA, 15 bp, Homo sapiens
ctattattaccctat

SEQ ID NO: 491900 - DNA, 15 bp, Homo sapiens
tattattaccctatg

SEQ ID NO: 491901 - DNA, 15 bp, Homo sapiens
attattaccctatgt

SEQ ID NO: 491902 - DNA, 15 bp, Homo sapiens
ttattaccctatgta

SEQ ID NO: 491903 - DNA, 15 bp, Homo sapiens
tattaccctatgtag

SEQ ID NO: 491904 - DNA, 15 bp, Homo sapiens
attaccctatgtaga

SEQ ID NO: 491905 - DNA, 15 bp, Homo sapiens
ttaccctatgtagag

SEQ ID NO: 491906 - DNA, 15 bp, Homo sapiens
taccctatgtagagt

SEQ ID NO: 491907 - DNA, 15 bp, Homo sapiens
accctatgtagagtg

SEQ ID NO: 491908 - DNA, 15 bp, Homo sapiens
ccctatgtagagtga

SEQ ID NO: 491909 - DNA, 15 bp, Homo sapiens
cctatgtagagtgat

SEQ ID NO: 491910 - DNA, 15 bp, Homo sapiens
ctatgtagagtgata

SEQ ID NO: 491911 - DNA, 15 bp, Homo sapiens
tatgtagagtgatac

SEQ ID NO: 491912 - DNA, 15 bp, Homo sapiens
atgtagagtgatact

SEQ ID NO: 491913 - DNA, 15 bp, Homo sapiens
tgtagagtgatactt

SEQ ID NO: 491914 - DNA, 15 bp, Homo sapiens
gtagagtgatacttt

SEQ ID NO: 491915 - DNA, 15 bp, Homo sapiens
tagagtgatactttc

SEQ ID NO: 491916 - DNA, 15 bp, Homo sapiens
agagtgatactttcc

SEQ ID NO: 491917 - DNA, 15 bp, Homo sapiens
gagtgatactttcca

SEQ ID NO: 491918 - DNA, 15 bp, Homo sapiens
agtgatactttccac

SEQ ID NO: 491919 - DNA, 15 bp, Homo sapiens
gtgatactttccacg

SEQ ID NO: 491920 - DNA, 15 bp, Homo sapiens
tgatactttccacgc

SEQ ID NO: 491921 - DNA, 15 bp, Homo sapiens
gatactttccacgca

SEQ ID NO: 491922 - DNA, 15 bp, Homo sapiens
atactttccacgcat

SEQ ID NO: 491923 - DNA, 15 bp, Homo sapiens
tactttccacgcatt

SEQ ID NO: 491924 - DNA, 15 bp, Homo sapiens
actttccacgcattt

SEQ ID NO: 491925 - DNA, 15 bp, Homo sapiens
ctttccacgcatttg

SEQ ID NO: 491926 - DNA, 15 bp, Homo sapiens
tttccacgcatttgc

SEQ ID NO: 491927 - DNA, 15 bp, Homo sapiens
ttccacgcatttgca

SEQ ID NO: 491928 - DNA, 15 bp, Homo sapiens
tccacgcatttgcat

SEQ ID NO: 491929 - DNA, 15 bp, Homo sapiens
ccacgcatttgcatg

SEQ ID NO: 491930 - DNA, 15 bp, Homo sapiens
cacgcatttgcatgc

SEQ ID NO: 491931 - DNA, 15 bp, Homo sapiens
acgcatttgcatgcc

SEQ ID NO: 491932 - DNA, 15 bp, Homo sapiens
cgcatttgcatgcct

SEQ ID NO: 491933 - DNA, 15 bp, Homo sapiens
gcatttgcatgcctg

SEQ ID NO: 491934 - DNA, 15 bp, Homo sapiens
catttgcatgcctga

SEQ ID NO: 491935 - DNA, 15 bp, Homo sapiens
atttgcatgcctgag

SEQ ID NO: 491936 - DNA, 15 bp, Homo sapiens
tttgcatgcctgaga

SEQ ID NO: 491937 - DNA, 15 bp, Homo sapiens
ttgcatgcctgagag

SEQ ID NO: 491938 - DNA, 15 bp, Homo sapiens
tgcatgcctgagagt

SEQ ID NO: 491939 - DNA, 15 bp, Homo sapiens
gcatgcctgagagtt

SEQ ID NO: 491940 - DNA, 15 bp, Homo sapiens
catgcctgagagttg

SEQ ID NO: 491941 - DNA, 15 bp, Homo sapiens
atgcctgagagttgg

SEQ ID NO: 491942 - DNA, 15 bp, Homo sapiens
tgcctgagagttgga

SEQ ID NO: 491943 - DNA, 15 bp, Homo sapiens
gcctgagagttggaa

SEQ ID NO: 491944 - DNA, 15 bp, Homo sapiens
cctgagagttggaac

SEQ ID NO: 491945 - DNA, 15 bp, Homo sapiens
ctgagagttggaacc

SEQ ID NO: 491946 - DNA, 15 bp, Homo sapiens
tgagagttggaacca

SEQ ID NO: 491947 - DNA, 15 bp, Homo sapiens
gagagttggaaccaa

SEQ ID NO: 491948 - DNA, 15 bp, Homo sapiens
agagttggaaccaac

SEQ ID NO: 491949 - DNA, 15 bp, Homo sapiens
gagttggaaccaaca

SEQ ID NO: 491950 - DNA, 15 bp, Homo sapiens
agttggaaccaacaa

SEQ ID NO: 491951 - DNA, 15 bp, Homo sapiens
gttggaaccaacaaa

SEQ ID NO: 491952 - DNA, 15 bp, Homo sapiens
ttggaaccaacaaag

SEQ ID NO: 491953 - DNA, 15 bp, Homo sapiens
tggaaccaacaaagt

SEQ ID NO: 491954 - DNA, 15 bp, Homo sapiens
ggaaccaacaaagta

SEQ ID NO: 491955 - DNA, 15 bp, Homo sapiens
gaaccaacaaagtaa

SEQ ID NO: 491956 - DNA, 15 bp, Homo sapiens
aaccaacaaagtaac

SEQ ID NO: 491957 - DNA, 15 bp, Homo sapiens
accaacaaagtaaca

SEQ ID NO: 491958 - DNA, 15 bp, Homo sapiens
ccaacaaagtaacag

SEQ ID NO: 491959 - DNA, 15 bp, Homo sapiens
caacaaagtaacagg

SEQ ID NO: 491960 - DNA, 15 bp, Homo sapiens
aacaaagtaacagga

SEQ ID NO: 491961 - DNA, 15 bp, Homo sapiens
acaaagtaacaggac

SEQ ID NO: 491962 - DNA, 15 bp, Homo sapiens
caaagtaacaggact

SEQ ID NO: 491963 - DNA, 15 bp, Homo sapiens
aaagtaacaggactg

SEQ ID NO: 491964 - DNA, 15 bp, Homo sapiens
aagtaacaggactgc

SEQ ID NO: 491965 - DNA, 15 bp, Homo sapiens
agtaacaggactgcc

SEQ ID NO: 491966 - DNA, 15 bp, Homo sapiens
gtaacaggactgcca

SEQ ID NO: 491967 - DNA, 15 bp, Homo sapiens
taacaggactgccat

SEQ ID NO: 491968 - DNA, 15 bp, Homo sapiens
aacaggactgccatt

SEQ ID NO: 491969 - DNA, 15 bp, Homo sapiens
acaggactgccatta

SEQ ID NO: 491970 - DNA, 15 bp, Homo sapiens
caggactgccattaa

SEQ ID NO: 491971 - DNA, 15 bp, Homo sapiens
aggactgccattaag

SEQ ID NO: 491972 - DNA, 15 bp, Homo sapiens
ggactgccattaagt

SEQ ID NO: 491973 - DNA, 15 bp, Homo sapiens
gactgccattaagtg

SEQ ID NO: 491974 - DNA, 15 bp, Homo sapiens
actgccattaagtga

SEQ ID NO: 491975 - DNA, 15 bp, Homo sapiens
ctgccattaagtgat

SEQ ID NO: 491976 - DNA, 15 bp, Homo sapiens
tgccattaagtgatt

SEQ ID NO: 491977 - DNA, 15 bp, Homo sapiens
gccattaagtgattt

SEQ ID NO: 491978 - DNA, 15 bp, Homo sapiens
ccattaagtgatttc

SEQ ID NO: 491979 - DNA, 15 bp, Homo sapiens
cattaagtgatttct

SEQ ID NO: 491980 - DNA, 15 bp, Homo sapiens
attaagtgatttctt

SEQ ID NO: 491981 - DNA, 15 bp, Homo sapiens
ttaagtgatttcttt

SEQ ID NO: 491982 - DNA, 15 bp, Homo sapiens
taagtgatttctttt

SEQ ID NO: 491983 - DNA, 15 bp, Homo sapiens
aagtgatttcttttg

SEQ ID NO: 491984 - DNA, 15 bp, Homo sapiens
agtgatttcttttgt

SEQ ID NO: 491985 - DNA, 15 bp, Homo sapiens
gtgatttcttttgtt

SEQ ID NO: 491986 - DNA, 15 bp, Homo sapiens
tgatttcttttgttt

SEQ ID NO: 491987 - DNA, 15 bp, Homo sapiens
gatttcttttgtttt

SEQ ID NO: 491988 - DNA, 15 bp, Homo sapiens
atttcttttgttttc

SEQ ID NO: 491989 - DNA, 15 bp, Homo sapiens
cttttgttttctctt

SEQ ID NO: 491990 - DNA, 15 bp, Homo sapiens
ttttgttttctcttt

SEQ ID NO: 491991 - DNA, 15 bp, Homo sapiens
tttgttttctctttc

SEQ ID NO: 491992 - DNA, 15 bp, Homo sapiens
ttgttttctctttca

SEQ ID NO: 491993 - DNA, 15 bp, Homo sapiens
tgttttctctttcag

SEQ ID NO: 491994 - DNA, 15 bp, Homo sapiens
gttttctctttcagc

SEQ ID NO: 491995 - DNA, 15 bp, Homo sapiens
ttttctctttcagca

SEQ ID NO: 491996 - DNA, 15 bp, Homo sapiens
tttctctttcagcaa

SEQ ID NO: 491997 - DNA, 15 bp, Homo sapiens
ttctctttcagcaaa

SEQ ID NO: 491998 - DNA, 15 bp, Homo sapiens
tctctttcagcaaat

SEQ ID NO: 491999 - DNA, 15 bp, Homo sapiens
ctctttcagcaaatg

SEQ ID NO: 492000 - DNA, 15 bp, Homo sapiens
tctttcagcaaatgt

SEQ ID NO: 492001 - DNA, 15 bp, Homo sapiens
ctttcagcaaatgtt

SEQ ID NO: 492002 - DNA, 15 bp, Homo sapiens
tttcagcaaatgttc

SEQ ID NO: 492003 - DNA, 15 bp, Homo sapiens
ttcagcaaatgttcc

SEQ ID NO: 492004 - DNA, 15 bp, Homo sapiens
tcagcaaatgttccc

SEQ ID NO: 492005 - DNA, 15 bp, Homo sapiens
cagcaaatgttccca

SEQ ID NO: 492006 - DNA, 15 bp, Homo sapiens
agcaaatgttcccag

SEQ ID NO: 492007 - DNA, 15 bp, Homo sapiens
gcaaatgttcccagc

SEQ ID NO: 492008 - DNA, 15 bp, Homo sapiens
caaatgttcccagca

SEQ ID NO: 492009 - DNA, 15 bp, Homo sapiens
aaatgttcccagcag

SEQ ID NO: 492010 - DNA, 15 bp, Homo sapiens
aatgttcccagcagg

SEQ ID NO: 492011 - DNA, 15 bp, Homo sapiens
atgttcccagcaggc

SEQ ID NO: 492012 - DNA, 15 bp, Homo sapiens
tgttcccagcaggcc

SEQ ID NO: 492013 - DNA, 15 bp, Homo sapiens
gttcccagcaggcca

SEQ ID NO: 492014 - DNA, 15 bp, Homo sapiens
ttcccagcaggccac

SEQ ID NO: 492015 - DNA, 15 bp, Homo sapiens
tcccagcaggccaca

SEQ ID NO: 492016 - DNA, 15 bp, Homo sapiens
cccagcaggccacag

SEQ ID NO: 492017 - DNA, 15 bp, Homo sapiens
ccagcaggccacagg

SEQ ID NO: 492018 - DNA, 15 bp, Homo sapiens
cagcaggccacaggt

SEQ ID NO: 492019 - DNA, 15 bp, Homo sapiens
agcaggccacaggta

SEQ ID NO: 492020 - DNA, 15 bp, Homo sapiens
gcaggccacaggtaa

SEQ ID NO: 492021 - DNA, 15 bp, Homo sapiens
caggccacaggtaag

SEQ ID NO: 492022 - DNA, 15 bp, Homo sapiens
aggccacaggtaaga

SEQ ID NO: 492023 - DNA, 15 bp, Homo sapiens
ggccacaggtaagag

SEQ ID NO: 492024 - DNA, 15 bp, Homo sapiens
gccacaggtaagagt

SEQ ID NO: 492025 - DNA, 15 bp, Homo sapiens
ccacaggtaagagtt

SEQ ID NO: 492026 - DNA, 15 bp, Homo sapiens
cacaggtaagagtta

SEQ ID NO: 492027 - DNA, 15 bp, Homo sapiens
acaggtaagagttaa

SEQ ID NO: 492028 - DNA, 15 bp, Homo sapiens
caggtaagagttaat

SEQ ID NO: 492029 - DNA, 15 bp, Homo sapiens
aggtaagagttaatg

SEQ ID NO: 492030 - DNA, 15 bp, Homo sapiens
ggtaagagttaatgg

SEQ ID NO: 492031 - DNA, 15 bp, Homo sapiens
gtaagagttaatggc

SEQ ID NO: 492032 - DNA, 15 bp, Homo sapiens
taagagttaatggct

SEQ ID NO: 492033 - DNA, 15 bp, Homo sapiens
aagagttaatggctt

SEQ ID NO: 492034 - DNA, 15 bp, Homo sapiens
agagttaatggcttg

SEQ ID NO: 492035 - DNA, 15 bp, Homo sapiens
gagttaatggcttgg

SEQ ID NO: 492036 - DNA, 15 bp, Homo sapiens
agttaatggcttggt

SEQ ID NO: 492037 - DNA, 15 bp, Homo sapiens
gttaatggcttggtt

SEQ ID NO: 492038 - DNA, 15 bp, Homo sapiens
ttaatggcttggttg

SEQ ID NO: 492039 - DNA, 15 bp, Homo sapiens
taatggcttggttgg

SEQ ID NO: 492040 - DNA, 15 bp, Homo sapiens
aatggcttggttggc

SEQ ID NO: 492041 - DNA, 15 bp, Homo sapiens
atggcttggttggct

SEQ ID NO: 492042 - DNA, 15 bp, Homo sapiens
tggcttggttggctc

SEQ ID NO: 492043 - DNA, 15 bp, Homo sapiens
ggcttggttggctct

SEQ ID NO: 492044 - DNA, 15 bp, Homo sapiens
gcttggttggctcta

SEQ ID NO: 492045 - DNA, 15 bp, Homo sapiens
cttggttggctctat

SEQ ID NO: 492046 - DNA, 15 bp, Homo sapiens
ttggttggctctatg

SEQ ID NO: 492047 - DNA, 15 bp, Homo sapiens
tggttggctctatgt

SEQ ID NO: 492048 - DNA, 15 bp, Homo sapiens
ggttggctctatgtt

SEQ ID NO: 492049 - DNA, 15 bp, Homo sapiens
gttggctctatgtta

SEQ ID NO: 492050 - DNA, 15 bp, Homo sapiens
ttggctctatgttac

SEQ ID NO: 492051 - DNA, 15 bp, Homo sapiens
tggctctatgttact

SEQ ID NO: 492052 - DNA, 15 bp, Homo sapiens
ggctctatgttactg

SEQ ID NO: 492053 - DNA, 15 bp, Homo sapiens
gctctatgttactga

SEQ ID NO: 492054 - DNA, 15 bp, Homo sapiens
ctctatgttactgat

SEQ ID NO: 492055 - DNA, 15 bp, Homo sapiens
tctatgttactgatc

SEQ ID NO: 492056 - DNA, 15 bp, Homo sapiens
ctatgttactgatcc

SEQ ID NO: 492057 - DNA, 15 bp, Homo sapiens
tatgttactgatccc

SEQ ID NO: 492058 - DNA, 15 bp, Homo sapiens
atgttactgatccca

SEQ ID NO: 492059 - DNA, 15 bp, Homo sapiens
tgttactgatcccaa

SEQ ID NO: 492060 - DNA, 15 bp, Homo sapiens
gttactgatcccaac

SEQ ID NO: 492061 - DNA, 15 bp, Homo sapiens
ttactgatcccaacc

SEQ ID NO: 492062 - DNA, 15 bp, Homo sapiens
tactgatcccaacct

SEQ ID NO: 492063 - DNA, 15 bp, Homo sapiens
actgatcccaaccta

SEQ ID NO: 492064 - DNA, 15 bp, Homo sapiens
ctgatcccaacctag

SEQ ID NO: 492065 - DNA, 15 bp, Homo sapiens
tgatcccaacctaga

SEQ ID NO: 492066 - DNA, 15 bp, Homo sapiens
gatcccaacctagag

SEQ ID NO: 492067 - DNA, 15 bp, Homo sapiens
atcccaacctagagt

SEQ ID NO: 492068 - DNA, 15 bp, Homo sapiens
tcccaacctagagta

SEQ ID NO: 492069 - DNA, 15 bp, Homo sapiens
cccaacctagagtaa

SEQ ID NO: 492070 - DNA, 15 bp, Homo sapiens
ccaacctagagtaag

SEQ ID NO: 492071 - DNA, 15 bp, Homo sapiens
caacctagagtaagc

SEQ ID NO: 492072 - DNA, 15 bp, Homo sapiens
aacctagagtaagca

SEQ ID NO: 492073 - DNA, 15 bp, Homo sapiens
acctagagtaagcag

SEQ ID NO: 492074 - DNA, 15 bp, Homo sapiens
cctagagtaagcaga

SEQ ID NO: 492075 - DNA, 15 bp, Homo sapiens
ctagagtaagcagat

SEQ ID NO: 492076 - DNA, 15 bp, Homo sapiens
tagagtaagcagatt

SEQ ID NO: 492077 - DNA, 15 bp, Homo sapiens
agagtaagcagatta

SEQ ID NO: 492078 - DNA, 15 bp, Homo sapiens
gagtaagcagattat

SEQ ID NO: 492079 - DNA, 15 bp, Homo sapiens
agtaagcagattatc

SEQ ID NO: 492080 - DNA, 15 bp, Homo sapiens
gtaagcagattatcc

SEQ ID NO: 492081 - DNA, 15 bp, Homo sapiens
taagcagattatcca

SEQ ID NO: 492082 - DNA, 15 bp, Homo sapiens
aagcagattatccac

SEQ ID NO: 492083 - DNA, 15 bp, Homo sapiens
agcagattatccacg

SEQ ID NO: 492084 - DNA, 15 bp, Homo sapiens
gcagattatccacga

SEQ ID NO: 492085 - DNA, 15 bp, Homo sapiens
cagattatccacgac

SEQ ID NO: 492086 - DNA, 15 bp, Homo sapiens
agattatccacgact

SEQ ID NO: 492087 - DNA, 15 bp, Homo sapiens
gattatccacgactg

SEQ ID NO: 492088 - DNA, 15 bp, Homo sapiens
attatccacgactga

SEQ ID NO: 492089 - DNA, 15 bp, Homo sapiens
ttatccacgactgat

SEQ ID NO: 492090 - DNA, 15 bp, Homo sapiens
tatccacgactgatt

SEQ ID NO: 492091 - DNA, 15 bp, Homo sapiens
atccacgactgattt

SEQ ID NO: 492092 - DNA, 15 bp, Homo sapiens
tccacgactgatttt

SEQ ID NO: 492093 - DNA, 15 bp, Homo sapiens
ccacgactgatttta

SEQ ID NO: 492094 - DNA, 15 bp, Homo sapiens
cacgactgattttat

SEQ ID NO: 492095 - DNA, 15 bp, Homo sapiens
acgactgattttatt

SEQ ID NO: 492096 - DNA, 15 bp, Homo sapiens
cgactgattttattc

SEQ ID NO: 492097 - DNA, 15 bp, Homo sapiens
gactgattttattcc

SEQ ID NO: 492098 - DNA, 15 bp, Homo sapiens
actgattttattcct

SEQ ID NO: 492099 - DNA, 15 bp, Homo sapiens
ctgattttattccta

SEQ ID NO: 492100 - DNA, 15 bp, Homo sapiens
tgattttattcctac

SEQ ID NO: 492101 - DNA, 15 bp, Homo sapiens
gattttattcctact

SEQ ID NO: 492102 - DNA, 15 bp, Homo sapiens
attttattcctactt

SEQ ID NO: 492103 - DNA, 15 bp, Homo sapiens
ttttattcctacttt

SEQ ID NO: 492104 - DNA, 15 bp, Homo sapiens
tttattcctacttta

SEQ ID NO: 492105 - DNA, 15 bp, Homo sapiens
ttattcctactttat

SEQ ID NO: 492106 - DNA, 15 bp, Homo sapiens
tattcctactttatt

SEQ ID NO: 492107 - DNA, 15 bp, Homo sapiens
attcctactttattc

SEQ ID NO: 492108 - DNA, 15 bp, Homo sapiens
ttcctactttattct

SEQ ID NO: 492109 - DNA, 15 bp, Homo sapiens
tcctactttattctc

SEQ ID NO: 492110 - DNA, 15 bp, Homo sapiens
cctactttattctcc

SEQ ID NO: 492111 - DNA, 15 bp, Homo sapiens
ctactttattctcca

SEQ ID NO: 492112 - DNA, 15 bp, Homo sapiens
tactttattctccat

SEQ ID NO: 492113 - DNA, 15 bp, Homo sapiens
actttattctccatg

SEQ ID NO: 492114 - DNA, 15 bp, Homo sapiens
ctttattctccatgt

SEQ ID NO: 492115 - DNA, 15 bp, Homo sapiens
tttattctccatgta

SEQ ID NO: 492116 - DNA, 15 bp, Homo sapiens
ttattctccatgtaa

SEQ ID NO: 492117 - DNA, 15 bp, Homo sapiens
tattctccatgtaaa

SEQ ID NO: 492118 - DNA, 15 bp, Homo sapiens
attctccatgtaaat

SEQ ID NO: 492119 - DNA, 15 bp, Homo sapiens
ttctccatgtaaata

SEQ ID NO: 492120 - DNA, 15 bp, Homo sapiens
tctccatgtaaataa

SEQ ID NO: 492121 - DNA, 15 bp, Homo sapiens
ctccatgtaaataag

SEQ ID NO: 492122 - DNA, 15 bp, Homo sapiens
tccatgtaaataagt

SEQ ID NO: 492123 - DNA, 15 bp, Homo sapiens
ccatgtaaataagta

SEQ ID NO: 492124 - DNA, 15 bp, Homo sapiens
catgtaaataagtaa

SEQ ID NO: 492125 - DNA, 15 bp, Homo sapiens
atgtaaataagtaaa

SEQ ID NO: 492126 - DNA, 15 bp, Homo sapiens
tgtaaataagtaaac

SEQ ID NO: 492127 - DNA, 15 bp, Homo sapiens
gtaaataagtaaact

SEQ ID NO: 492128 - DNA, 15 bp, Homo sapiens
taaataagtaaactt

SEQ ID NO: 492129 - DNA, 15 bp, Homo sapiens
aaataagtaaactta

SEQ ID NO: 492130 - DNA, 15 bp, Homo sapiens
aataagtaaacttac

SEQ ID NO: 492131 - DNA, 15 bp, Homo sapiens
ataagtaaacttact

SEQ ID NO: 492132 - DNA, 15 bp, Homo sapiens
taagtaaacttactt

SEQ ID NO: 492133 - DNA, 15 bp, Homo sapiens
aagtaaacttacttg

SEQ ID NO: 492134 - DNA, 15 bp, Homo sapiens
agtaaacttacttga

SEQ ID NO: 492135 - DNA, 15 bp, Homo sapiens
gtaaacttacttgac

SEQ ID NO: 492136 - DNA, 15 bp, Homo sapiens
taaacttacttgaca

SEQ ID NO: 492137 - DNA, 15 bp, Homo sapiens
aaacttacttgacat

SEQ ID NO: 492138 - DNA, 15 bp, Homo sapiens
aacttacttgacatt

SEQ ID NO: 492139 - DNA, 15 bp, Homo sapiens
acttacttgacattt

SEQ ID NO: 492140 - DNA, 15 bp, Homo sapiens
cttacttgacattta

SEQ ID NO: 492141 - DNA, 15 bp, Homo sapiens
ttacttgacatttaa

SEQ ID NO: 492142 - DNA, 15 bp, Homo sapiens
tacttgacatttaaa

SEQ ID NO: 492143 - DNA, 15 bp, Homo sapiens
acttgacatttaaat

SEQ ID NO: 492144 - DNA, 15 bp, Homo sapiens
cttgacatttaaatg

SEQ ID NO: 492145 - DNA, 15 bp, Homo sapiens
ttgacatttaaatgt

SEQ ID NO: 492146 - DNA, 15 bp, Homo sapiens
tgacatttaaatgtt

SEQ ID NO: 492147 - DNA, 15 bp, Homo sapiens
gacatttaaatgtta

SEQ ID NO: 492148 - DNA, 15 bp, Homo sapiens
acatttaaatgttag

SEQ ID NO: 492149 - DNA, 15 bp, Homo sapiens
catttaaatgttagt

SEQ ID NO: 492150 - DNA, 15 bp, Homo sapiens
atttaaatgttagtt

SEQ ID NO: 492151 - DNA, 15 bp, Homo sapiens
tttaaatgttagttg

SEQ ID NO: 492152 - DNA, 15 bp, Homo sapiens
ttaaatgttagttga

SEQ ID NO: 492153 - DNA, 15 bp, Homo sapiens
taaatgttagttgat

SEQ ID NO: 492154 - DNA, 15 bp, Homo sapiens
aaatgttagttgatt

SEQ ID NO: 492155 - DNA, 15 bp, Homo sapiens
aatgttagttgattc

SEQ ID NO: 492156 - DNA, 15 bp, Homo sapiens
atgttagttgattct

SEQ ID NO: 492157 - DNA, 15 bp, Homo sapiens
tgttagttgattctg

SEQ ID NO: 492158 - DNA, 15 bp, Homo sapiens
gttagttgattctgt

SEQ ID NO: 492159 - DNA, 15 bp, Homo sapiens
ttagttgattctgta

SEQ ID NO: 492160 - DNA, 15 bp, Homo sapiens
tagttgattctgtac

SEQ ID NO: 492161 - DNA, 15 bp, Homo sapiens
agttgattctgtaca

SEQ ID NO: 492162 - DNA, 15 bp, Homo sapiens
gttgattctgtacaa

SEQ ID NO: 492163 - DNA, 15 bp, Homo sapiens
ttgattctgtacaac

SEQ ID NO: 492164 - DNA, 15 bp, Homo sapiens
tgattctgtacaaca

SEQ ID NO: 492165 - DNA, 15 bp, Homo sapiens
gattctgtacaacag

SEQ ID NO: 492166 - DNA, 15 bp, Homo sapiens
attctgtacaacagt

SEQ ID NO: 492167 - DNA, 15 bp, Homo sapiens
ttctgtacaacagtt

SEQ ID NO: 492168 - DNA, 15 bp, Homo sapiens
tctgtacaacagttt

SEQ ID NO: 492169 - DNA, 15 bp, Homo sapiens
ctgtacaacagtttg

SEQ ID NO: 492170 - DNA, 15 bp, Homo sapiens
tgtacaacagtttgt

SEQ ID NO: 492171 - DNA, 15 bp, Homo sapiens
gtacaacagtttgtc

SEQ ID NO: 492172 - DNA, 15 bp, Homo sapiens
tacaacagtttgtca

SEQ ID NO: 492173 - DNA, 15 bp, Homo sapiens
acaacagtttgtcag

SEQ ID NO: 492174 - DNA, 15 bp, Homo sapiens
caacagtttgtcagt

SEQ ID NO: 492175 - DNA, 15 bp, Homo sapiens
aacagtttgtcagtc

SEQ ID NO: 492176 - DNA, 15 bp, Homo sapiens
acagtttgtcagtct

SEQ ID NO: 492177 - DNA, 15 bp, Homo sapiens
cagtttgtcagtctg

SEQ ID NO: 492178 - DNA, 15 bp, Homo sapiens
agtttgtcagtctgg

SEQ ID NO: 492179 - DNA, 15 bp, Homo sapiens
gtttgtcagtctggg

SEQ ID NO: 492180 - DNA, 15 bp, Homo sapiens
tttgtcagtctggga

SEQ ID NO: 492181 - DNA, 15 bp, Homo sapiens
ttgtcagtctgggag

SEQ ID NO: 492182 - DNA, 15 bp, Homo sapiens
tgtcagtctgggagt

SEQ ID NO: 492183 - DNA, 15 bp, Homo sapiens
gtcagtctgggagtg

SEQ ID NO: 492184 - DNA, 15 bp, Homo sapiens
tcagtctgggagtgg

SEQ ID NO: 492185 - DNA, 15 bp, Homo sapiens
cagtctgggagtggg

SEQ ID NO: 492186 - DNA, 15 bp, Homo sapiens
agtctgggagtgggg

SEQ ID NO: 492187 - DNA, 15 bp, Homo sapiens
gtctgggagtggggg

SEQ ID NO: 492188 - DNA, 15 bp, Homo sapiens
tctgggagtgggggg

SEQ ID NO: 492189 - DNA, 15 bp, Homo sapiens
ctgggagtggggggt

SEQ ID NO: 492190 - DNA, 15 bp, Homo sapiens
tgggagtggggggtg

SEQ ID NO: 492191 - DNA, 15 bp, Homo sapiens
gggagtggggggtgg

SEQ ID NO: 492192 - DNA, 15 bp, Homo sapiens
ggagtggggggtggc

SEQ ID NO: 492193 - DNA, 15 bp, Homo sapiens
gagtggggggtggct

SEQ ID NO: 492194 - DNA, 15 bp, Homo sapiens
agtggggggtggctc

SEQ ID NO: 492195 - DNA, 15 bp, Homo sapiens
gtggggggtggctcc

SEQ ID NO: 492196 - DNA, 15 bp, Homo sapiens
tggggggtggctccc

SEQ ID NO: 492197 - DNA, 15 bp, Homo sapiens
ggggggtggctccca

SEQ ID NO: 492198 - DNA, 15 bp, Homo sapiens
gggggtggctcccaa

SEQ ID NO: 492199 - DNA, 15 bp, Homo sapiens
ggggtggctcccaag

SEQ ID NO: 492200 - DNA, 15 bp, Homo sapiens
gggtggctcccaagc

SEQ ID NO: 492201 - DNA, 15 bp, Homo sapiens
ggtggctcccaagcc

SEQ ID NO: 492202 - DNA, 15 bp, Homo sapiens
gtggctcccaagcca

SEQ ID NO: 492203 - DNA, 15 bp, Homo sapiens
tggctcccaagccac

SEQ ID NO: 492204 - DNA, 15 bp, Homo sapiens
ggctcccaagccaca

SEQ ID NO: 492205 - DNA, 15 bp, Homo sapiens
gctcccaagccacag

SEQ ID NO: 492206 - DNA, 15 bp, Homo sapiens
ctcccaagccacaga

SEQ ID NO: 492207 - DNA, 15 bp, Homo sapiens
tcccaagccacagat

SEQ ID NO: 492208 - DNA, 15 bp, Homo sapiens
cccaagccacagata

SEQ ID NO: 492209 - DNA, 15 bp, Homo sapiens
ccaagccacagatac

SEQ ID NO: 492210 - DNA, 15 bp, Homo sapiens
caagccacagatacc

SEQ ID NO: 492211 - DNA, 15 bp, Homo sapiens
aagccacagatacca

SEQ ID NO: 492212 - DNA, 15 bp, Homo sapiens
agccacagataccaa

SEQ ID NO: 492213 - DNA, 15 bp, Homo sapiens
gccacagataccaaa

SEQ ID NO: 492214 - DNA, 15 bp, Homo sapiens
ccacagataccaaaa

SEQ ID NO: 492215 - DNA, 15 bp, Homo sapiens
cacagataccaaaaa

SEQ ID NO: 492216 - DNA, 15 bp, Homo sapiens
acagataccaaaaat

SEQ ID NO: 492217 - DNA, 15 bp, Homo sapiens
cagataccaaaaata

SEQ ID NO: 492218 - DNA, 15 bp, Homo sapiens
agataccaaaaatac

SEQ ID NO: 492219 - DNA, 15 bp, Homo sapiens
gataccaaaaatacc

SEQ ID NO: 492220 - DNA, 15 bp, Homo sapiens
ataccaaaaatacca

SEQ ID NO: 492221 - DNA, 15 bp, Homo sapiens
taccaaaaataccat

SEQ ID NO: 492222 - DNA, 15 bp, Homo sapiens
accaaaaataccatg

SEQ ID NO: 492223 - DNA, 15 bp, Homo sapiens
ccaaaaataccatgt

SEQ ID NO: 492224 - DNA, 15 bp, Homo sapiens
caaaaataccatgtg

SEQ ID NO: 492225 - DNA, 15 bp, Homo sapiens
aaaaataccatgtgt

SEQ ID NO: 492226 - DNA, 15 bp, Homo sapiens
aaaataccatgtgtt

SEQ ID NO: 492227 - DNA, 15 bp, Homo sapiens
aaataccatgtgttt

SEQ ID NO: 492228 - DNA, 15 bp, Homo sapiens
aataccatgtgtttg

SEQ ID NO: 492229 - DNA, 15 bp, Homo sapiens
ataccatgtgtttga

SEQ ID NO: 492230 - DNA, 15 bp, Homo sapiens
taccatgtgtttgat

SEQ ID NO: 492231 - DNA, 15 bp, Homo sapiens
accatgtgtttgatc

SEQ ID NO: 492232 - DNA, 15 bp, Homo sapiens
ccatgtgtttgatcc

SEQ ID NO: 492233 - DNA, 15 bp, Homo sapiens
catgtgtttgatcct

SEQ ID NO: 492234 - DNA, 15 bp, Homo sapiens
atgtgtttgatcctt

SEQ ID NO: 492235 - DNA, 15 bp, Homo sapiens
tgtgtttgatccttt

SEQ ID NO: 492236 - DNA, 15 bp, Homo sapiens
gtgtttgatcctttg

SEQ ID NO: 492237 - DNA, 15 bp, Homo sapiens
tgtttgatcctttgt

SEQ ID NO: 492238 - DNA, 15 bp, Homo sapiens
gtttgatcctttgtg

SEQ ID NO: 492239 - DNA, 15 bp, Homo sapiens
tttgatcctttgtgt

SEQ ID NO: 492240 - DNA, 15 bp, Homo sapiens
ttgatcctttgtgtt

SEQ ID NO: 492241 - DNA, 15 bp, Homo sapiens
tgatcctttgtgttc

SEQ ID NO: 492242 - DNA, 15 bp, Homo sapiens
gatcctttgtgttct

SEQ ID NO: 492243 - DNA, 15 bp, Homo sapiens
atcctttgtgttcta

SEQ ID NO: 492244 - DNA, 15 bp, Homo sapiens
tcctttgtgttctaa

SEQ ID NO: 492245 - DNA, 15 bp, Homo sapiens
cctttgtgttctaac

SEQ ID NO: 492246 - DNA, 15 bp, Homo sapiens
ctttgtgttctaaca

SEQ ID NO: 492247 - DNA, 15 bp, Homo sapiens
tttgtgttctaacag

SEQ ID NO: 492248 - DNA, 15 bp, Homo sapiens
ttgtgttctaacagc

SEQ ID NO: 492249 - DNA, 15 bp, Homo sapiens
tgtgttctaacagct

SEQ ID NO: 492250 - DNA, 15 bp, Homo sapiens
gtgttctaacagctt

SEQ ID NO: 492251 - DNA, 15 bp, Homo sapiens
tgttctaacagcttt

SEQ ID NO: 492252 - DNA, 15 bp, Homo sapiens
gttctaacagctttt

SEQ ID NO: 492253 - DNA, 15 bp, Homo sapiens
ttctaacagcttttt

SEQ ID NO: 492254 - DNA, 15 bp, Homo sapiens
tctaacagcttttta

SEQ ID NO: 492255 - DNA, 15 bp, Homo sapiens
ctaacagctttttaa

SEQ ID NO: 492256 - DNA, 15 bp, Homo sapiens
taacagctttttaat

SEQ ID NO: 492257 - DNA, 15 bp, Homo sapiens
aacagctttttaatg

SEQ ID NO: 492258 - DNA, 15 bp, Homo sapiens
acagctttttaatgg

SEQ ID NO: 492259 - DNA, 15 bp, Homo sapiens
cagctttttaatggc

SEQ ID NO: 492260 - DNA, 15 bp, Homo sapiens
agctttttaatggca

SEQ ID NO: 492261 - DNA, 15 bp, Homo sapiens
gctttttaatggcat

SEQ ID NO: 492262 - DNA, 15 bp, Homo sapiens
ctttttaatggcatc

SEQ ID NO: 492263 - DNA, 15 bp, Homo sapiens
tttttaatggcatct

SEQ ID NO: 492264 - DNA, 15 bp, Homo sapiens
ttttaatggcatctt

SEQ ID NO: 492265 - DNA, 15 bp, Homo sapiens
tttaatggcatctta

SEQ ID NO: 492266 - DNA, 15 bp, Homo sapiens
ttaatggcatcttat

SEQ ID NO: 492267 - DNA, 15 bp, Homo sapiens
taatggcatcttatg

SEQ ID NO: 492268 - DNA, 15 bp, Homo sapiens
aatggcatcttatgt

SEQ ID NO: 492269 - DNA, 15 bp, Homo sapiens
atggcatcttatgtg

SEQ ID NO: 492270 - DNA, 15 bp, Homo sapiens
tggcatcttatgtgc

SEQ ID NO: 492271 - DNA, 15 bp, Homo sapiens
ggcatcttatgtgct

SEQ ID NO: 492272 - DNA, 15 bp, Homo sapiens
gcatcttatgtgcta

SEQ ID NO: 492273 - DNA, 15 bp, Homo sapiens
catcttatgtgctac

SEQ ID NO: 492274 - DNA, 15 bp, Homo sapiens
atcttatgtgctaca

SEQ ID NO: 492275 - DNA, 15 bp, Homo sapiens
tcttatgtgctacat

SEQ ID NO: 492276 - DNA, 15 bp, Homo sapiens
cttatgtgctacata

SEQ ID NO: 492277 - DNA, 15 bp, Homo sapiens
ttatgtgctacataa

SEQ ID NO: 492278 - DNA, 15 bp, Homo sapiens
tatgtgctacataaa

SEQ ID NO: 492279 - DNA, 15 bp, Homo sapiens
atgtgctacataaag

SEQ ID NO: 492280 - DNA, 15 bp, Homo sapiens
tgtgctacataaagt

SEQ ID NO: 492281 - DNA, 15 bp, Homo sapiens
gtgctacataaagtc

SEQ ID NO: 492282 - DNA, 15 bp, Homo sapiens
tgctacataaagtca

SEQ ID NO: 492283 - DNA, 15 bp, Homo sapiens
gctacataaagtcac

SEQ ID NO: 492284 - DNA, 15 bp, Homo sapiens
ctacataaagtcact

SEQ ID NO: 492285 - DNA, 15 bp, Homo sapiens
tacataaagtcactc

SEQ ID NO: 492286 - DNA, 15 bp, Homo sapiens
acataaagtcactct

SEQ ID NO: 492287 - DNA, 15 bp, Homo sapiens
cataaagtcactcta

SEQ ID NO: 492288 - DNA, 15 bp, Homo sapiens
ataaagtcactctag

SEQ ID NO: 492289 - DNA, 15 bp, Homo sapiens
taaagtcactctaga

SEQ ID NO: 492290 - DNA, 15 bp, Homo sapiens
aaagtcactctagat

SEQ ID NO: 492291 - DNA, 15 bp, Homo sapiens
aagtcactctagata

SEQ ID NO: 492292 - DNA, 15 bp, Homo sapiens
agtcactctagatag

SEQ ID NO: 492293 - DNA, 15 bp, Homo sapiens
gtcactctagataga

SEQ ID NO: 492294 - DNA, 15 bp, Homo sapiens
tcactctagatagat

SEQ ID NO: 492295 - DNA, 15 bp, Homo sapiens
cactctagatagatt

SEQ ID NO: 492296 - DNA, 15 bp, Homo sapiens
actctagatagattt

SEQ ID NO: 492297 - DNA, 15 bp, Homo sapiens
ctctagatagatttg

SEQ ID NO: 492298 - DNA, 15 bp, Homo sapiens
tctagatagatttga

SEQ ID NO: 492299 - DNA, 15 bp, Homo sapiens
ctagatagatttgac

SEQ ID NO: 492300 - DNA, 15 bp, Homo sapiens
tagatagatttgacc

SEQ ID NO: 492301 - DNA, 15 bp, Homo sapiens
agatagatttgacca

SEQ ID NO: 492302 - DNA, 15 bp, Homo sapiens
gatagatttgaccac

SEQ ID NO: 492303 - DNA, 15 bp, Homo sapiens
atagatttgaccacc

SEQ ID NO: 492304 - DNA, 15 bp, Homo sapiens
tagatttgaccacca

SEQ ID NO: 492305 - DNA, 15 bp, Homo sapiens
agatttgaccaccac

SEQ ID NO: 492306 - DNA, 15 bp, Homo sapiens
gatttgaccaccact

SEQ ID NO: 492307 - DNA, 15 bp, Homo sapiens
atttgaccaccactg

SEQ ID NO: 492308 - DNA, 15 bp, Homo sapiens
tttgaccaccactgc

SEQ ID NO: 492309 - DNA, 15 bp, Homo sapiens
ttgaccaccactgct

SEQ ID NO: 492310 - DNA, 15 bp, Homo sapiens
tgaccaccactgctc

SEQ ID NO: 492311 - DNA, 15 bp, Homo sapiens
gaccaccactgctct

SEQ ID NO: 492312 - DNA, 15 bp, Homo sapiens
accaccactgctctc

SEQ ID NO: 492313 - DNA, 15 bp, Homo sapiens
ccaccactgctctct

SEQ ID NO: 492314 - DNA, 15 bp, Homo sapiens
caccactgctctctc

SEQ ID NO: 492315 - DNA, 15 bp, Homo sapiens
accactgctctctca

SEQ ID NO: 492316 - DNA, 15 bp, Homo sapiens
ccactgctctctcaa

SEQ ID NO: 492317 - DNA, 15 bp, Homo sapiens
cactgctctctcaaa

SEQ ID NO: 492318 - DNA, 15 bp, Homo sapiens
actgctctctcaaat

SEQ ID NO: 492319 - DNA, 15 bp, Homo sapiens
ctgctctctcaaatg

SEQ ID NO: 492320 - DNA, 15 bp, Homo sapiens
tgctctctcaaatgt

SEQ ID NO: 492321 - DNA, 15 bp, Homo sapiens
gctctctcaaatgtc

SEQ ID NO: 492322 - DNA, 15 bp, Homo sapiens
ctctctcaaatgtct

SEQ ID NO: 492323 - DNA, 15 bp, Homo sapiens
tctctcaaatgtcta

SEQ ID NO: 492324 - DNA, 15 bp, Homo sapiens
ctctcaaatgtctac

SEQ ID NO: 492325 - DNA, 15 bp, Homo sapiens
tctcaaatgtctact

SEQ ID NO: 492326 - DNA, 15 bp, Homo sapiens
ctcaaatgtctactt

SEQ ID NO: 492327 - DNA, 15 bp, Homo sapiens
tcaaatgtctactta

SEQ ID NO: 492328 - DNA, 15 bp, Homo sapiens
caaatgtctacttaa

SEQ ID NO: 492329 - DNA, 15 bp, Homo sapiens
aaatgtctacttaag

SEQ ID NO: 492330 - DNA, 15 bp, Homo sapiens
aatgtctacttaagg

SEQ ID NO: 492331 - DNA, 15 bp, Homo sapiens
atgtctacttaaggt

SEQ ID NO: 492332 - DNA, 15 bp, Homo sapiens
tgtctacttaaggtg

SEQ ID NO: 492333 - DNA, 15 bp, Homo sapiens
gtctacttaaggtgg

SEQ ID NO: 492334 - DNA, 15 bp, Homo sapiens
tctacttaaggtggc

SEQ ID NO: 492335 - DNA, 15 bp, Homo sapiens
ctacttaaggtggct

SEQ ID NO: 492336 - DNA, 15 bp, Homo sapiens
tacttaaggtggcta

SEQ ID NO: 492337 - DNA, 15 bp, Homo sapiens
acttaaggtggctat

SEQ ID NO: 492338 - DNA, 15 bp, Homo sapiens
cttaaggtggctatc

SEQ ID NO: 492339 - DNA, 15 bp, Homo sapiens
ttaaggtggctatca

SEQ ID NO: 492340 - DNA, 15 bp, Homo sapiens
taaggtggctatcac

SEQ ID NO: 492341 - DNA, 15 bp, Homo sapiens
aaggtggctatcaca

SEQ ID NO: 492342 - DNA, 15 bp, Homo sapiens
aggtggctatcacag

SEQ ID NO: 492343 - DNA, 15 bp, Homo sapiens
ggtggctatcacaga

SEQ ID NO: 492344 - DNA, 15 bp, Homo sapiens
gtggctatcacagaa

SEQ ID NO: 492345 - DNA, 15 bp, Homo sapiens
tggctatcacagaac

SEQ ID NO: 492346 - DNA, 15 bp, Homo sapiens
ggctatcacagaaca

SEQ ID NO: 492347 - DNA, 15 bp, Homo sapiens
gctatcacagaacat

SEQ ID NO: 492348 - DNA, 15 bp, Homo sapiens
ctatcacagaacatt

SEQ ID NO: 492349 - DNA, 15 bp, Homo sapiens
tatcacagaacattg

SEQ ID NO: 492350 - DNA, 15 bp, Homo sapiens
atcacagaacattga

SEQ ID NO: 492351 - DNA, 15 bp, Homo sapiens
tcacagaacattgac

SEQ ID NO: 492352 - DNA, 15 bp, Homo sapiens
cacagaacattgacc

SEQ ID NO: 492353 - DNA, 15 bp, Homo sapiens
acagaacattgacct

SEQ ID NO: 492354 - DNA, 15 bp, Homo sapiens
cagaacattgaccta

SEQ ID NO: 492355 - DNA, 15 bp, Homo sapiens
agaacattgacctaa

SEQ ID NO: 492356 - DNA, 15 bp, Homo sapiens
gaacattgacctaaa

SEQ ID NO: 492357 - DNA, 15 bp, Homo sapiens
aacattgacctaaaa

SEQ ID NO: 492358 - DNA, 15 bp, Homo sapiens
acattgacctaaaaa

SEQ ID NO: 492359 - DNA, 15 bp, Homo sapiens
cattgacctaaaaaa

SEQ ID NO: 492360 - DNA, 15 bp, Homo sapiens
attgacctaaaaaaa

SEQ ID NO: 492361 - DNA, 15 bp, Homo sapiens
ttgacctaaaaaaaa

SEQ ID NO: 492362 - DNA, 15 bp, Homo sapiens
tgacctaaaaaaaaa

SEQ ID NO: 492363 - DNA, 15 bp, Homo sapiens
gacctaaaaaaaaaa

SEQ ID NO: 492364 - DNA, 15 bp, Homo sapiens
acctaaaaaaaaaat

SEQ ID NO: 492365 - DNA, 15 bp, Homo sapiens
cctaaaaaaaaaatg

SEQ ID NO: 492366 - DNA, 15 bp, Homo sapiens
ctaaaaaaaaaatga

SEQ ID NO: 492367 - DNA, 15 bp, Homo sapiens
taaaaaaaaaatgac

SEQ ID NO: 492368 - DNA, 15 bp, Homo sapiens
aaaaaaaaatgactg

SEQ ID NO: 492369 - DNA, 15 bp, Homo sapiens
aaaaaaaatgactgg

SEQ ID NO: 492370 - DNA, 15 bp, Homo sapiens
aaaaaaatgactggt

SEQ ID NO: 492371 - DNA, 15 bp, Homo sapiens
aaaaaatgactggta

SEQ ID NO: 492372 - DNA, 15 bp, Homo sapiens
aaaaatgactggtac

SEQ ID NO: 492373 - DNA, 15 bp, Homo sapiens
aaaatgactggtacc

SEQ ID NO: 492374 - DNA, 15 bp, Homo sapiens
aaatgactggtacca

SEQ ID NO: 492375 - DNA, 15 bp, Homo sapiens
aatgactggtaccac

SEQ ID NO: 492376 - DNA, 15 bp, Homo sapiens
atgactggtaccaca

SEQ ID NO: 492377 - DNA, 15 bp, Homo sapiens
tgactggtaccacag

SEQ ID NO: 492378 - DNA, 15 bp, Homo sapiens
gactggtaccacaga

SEQ ID NO: 492379 - DNA, 15 bp, Homo sapiens
actggtaccacagag

SEQ ID NO: 492380 - DNA, 15 bp, Homo sapiens
ctggtaccacagagg

SEQ ID NO: 492381 - DNA, 15 bp, Homo sapiens
tggtaccacagaggt

SEQ ID NO: 492382 - DNA, 15 bp, Homo sapiens
ggtaccacagaggtg

SEQ ID NO: 492383 - DNA, 15 bp, Homo sapiens
gtaccacagaggtgg

SEQ ID NO: 492384 - DNA, 15 bp, Homo sapiens
taccacagaggtggt

SEQ ID NO: 492385 - DNA, 15 bp, Homo sapiens
accacagaggtggtt

SEQ ID NO: 492386 - DNA, 15 bp, Homo sapiens
ccacagaggtggttt

SEQ ID NO: 492387 - DNA, 15 bp, Homo sapiens
cacagaggtggtttt

SEQ ID NO: 492388 - DNA, 15 bp, Homo sapiens
acagaggtggttttg

SEQ ID NO: 492389 - DNA, 15 bp, Homo sapiens
cagaggtggttttgt

SEQ ID NO: 492390 - DNA, 15 bp, Homo sapiens
aggtggttttgttac

SEQ ID NO: 492391 - DNA, 15 bp, Homo sapiens
ggtggttttgttact

SEQ ID NO: 492392 - DNA, 15 bp, Homo sapiens
gtggttttgttactt

SEQ ID NO: 492393 - DNA, 15 bp, Homo sapiens
tggttttgttacttt

SEQ ID NO: 492394 - DNA, 15 bp, Homo sapiens
ggttttgttactttg

SEQ ID NO: 492395 - DNA, 15 bp, Homo sapiens
gttttgttactttgc

SEQ ID NO: 492396 - DNA, 15 bp, Homo sapiens
ttttgttactttgca

SEQ ID NO: 492397 - DNA, 15 bp, Homo sapiens
tttgttactttgcag

SEQ ID NO: 492398 - DNA, 15 bp, Homo sapiens
ttgttactttgcagg

SEQ ID NO: 492399 - DNA, 15 bp, Homo sapiens
tgttactttgcaggg

SEQ ID NO: 492400 - DNA, 15 bp, Homo sapiens
gttactttgcagggg

SEQ ID NO: 492401 - DNA, 15 bp, Homo sapiens
ttactttgcagggga

SEQ ID NO: 492402 - DNA, 15 bp, Homo sapiens
tactttgcaggggaa

SEQ ID NO: 492403 - DNA, 15 bp, Homo sapiens
actttgcaggggaaa

SEQ ID NO: 492404 - DNA, 15 bp, Homo sapiens
ctttgcaggggaaaa

SEQ ID NO: 492405 - DNA, 15 bp, Homo sapiens
tttgcaggggaaaat

SEQ ID NO: 492406 - DNA, 15 bp, Homo sapiens
ttgcaggggaaaata

SEQ ID NO: 492407 - DNA, 15 bp, Homo sapiens
tgcaggggaaaatat

SEQ ID NO: 492408 - DNA, 15 bp, Homo sapiens
gcaggggaaaatatt

SEQ ID NO: 492409 - DNA, 15 bp, Homo sapiens
caggggaaaatattt

SEQ ID NO: 492410 - DNA, 15 bp, Homo sapiens
aggggaaaatatttc

SEQ ID NO: 492411 - DNA, 15 bp, Homo sapiens
ggggaaaatatttca

SEQ ID NO: 492412 - DNA, 15 bp, Homo sapiens
gggaaaatatttcaa

SEQ ID NO: 492413 - DNA, 15 bp, Homo sapiens
ggaaaatatttcaat

SEQ ID NO: 492414 - DNA, 15 bp, Homo sapiens
gaaaatatttcaatt

SEQ ID NO: 492415 - DNA, 15 bp, Homo sapiens
aaaatatttcaattt

SEQ ID NO: 492416 - DNA, 15 bp, Homo sapiens
aaatatttcaatttt

SEQ ID NO: 492417 - DNA, 15 bp, Homo sapiens
aatatttcaattttt

SEQ ID NO: 492418 - DNA, 15 bp, Homo sapiens
atatttcaatttttt

SEQ ID NO: 492419 - DNA, 15 bp, Homo sapiens
tatttcaatttttta

SEQ ID NO: 492420 - DNA, 15 bp, Homo sapiens
atttcaattttttac

SEQ ID NO: 492421 - DNA, 15 bp, Homo sapiens
tttcaattttttact

SEQ ID NO: 492422 - DNA, 15 bp, Homo sapiens
ttcaattttttactt

SEQ ID NO: 492423 - DNA, 15 bp, Homo sapiens
tcaattttttactta

SEQ ID NO: 492424 - DNA, 15 bp, Homo sapiens
caattttttacttaa

SEQ ID NO: 492425 - DNA, 15 bp, Homo sapiens
aattttttacttaaa

SEQ ID NO: 492426 - DNA, 15 bp, Homo sapiens
attttttacttaaaa

SEQ ID NO: 492427 - DNA, 15 bp, Homo sapiens
ttttttacttaaaaa

SEQ ID NO: 492428 - DNA, 15 bp, Homo sapiens
tttttacttaaaaat

SEQ ID NO: 492429 - DNA, 15 bp, Homo sapiens
ttttacttaaaaatt

SEQ ID NO: 492430 - DNA, 15 bp, Homo sapiens
tttacttaaaaattt

SEQ ID NO: 492431 - DNA, 15 bp, Homo sapiens
ttacttaaaaatttt

SEQ ID NO: 492432 - DNA, 15 bp, Homo sapiens
tacttaaaaattttg

SEQ ID NO: 492433 - DNA, 15 bp, Homo sapiens
acttaaaaattttgc

SEQ ID NO: 492434 - DNA, 15 bp, Homo sapiens
cttaaaaattttgct

SEQ ID NO: 492435 - DNA, 15 bp, Homo sapiens
ttaaaaattttgctg

SEQ ID NO: 492436 - DNA, 15 bp, Homo sapiens
taaaaattttgctga

SEQ ID NO: 492437 - DNA, 15 bp, Homo sapiens
aaaaattttgctgag

SEQ ID NO: 492438 - DNA, 15 bp, Homo sapiens
aaaattttgctgaga

SEQ ID NO: 492439 - DNA, 15 bp, Homo sapiens
aaattttgctgagaa

SEQ ID NO: 492440 - DNA, 15 bp, Homo sapiens
aattttgctgagaac

SEQ ID NO: 492441 - DNA, 15 bp, Homo sapiens
attttgctgagaact

SEQ ID NO: 492442 - DNA, 15 bp, Homo sapiens
ttttgctgagaactg

SEQ ID NO: 492443 - DNA, 15 bp, Homo sapiens
tttgctgagaactgt

SEQ ID NO: 492444 - DNA, 15 bp, Homo sapiens
ttgctgagaactgtt

SEQ ID NO: 492445 - DNA, 15 bp, Homo sapiens
tgctgagaactgttg

SEQ ID NO: 492446 - DNA, 15 bp, Homo sapiens
gctgagaactgttgg

SEQ ID NO: 492447 - DNA, 15 bp, Homo sapiens
ctgagaactgttggc

SEQ ID NO: 492448 - DNA, 15 bp, Homo sapiens
tgagaactgttggca

SEQ ID NO: 492449 - DNA, 15 bp, Homo sapiens
gagaactgttggcag

SEQ ID NO: 492450 - DNA, 15 bp, Homo sapiens
agaactgttggcagc

SEQ ID NO: 492451 - DNA, 15 bp, Homo sapiens
gaactgttggcagct

SEQ ID NO: 492452 - DNA, 15 bp, Homo sapiens
aactgttggcagctg

SEQ ID NO: 492453 - DNA, 15 bp, Homo sapiens
actgttggcagctgt

SEQ ID NO: 492454 - DNA, 15 bp, Homo sapiens
ctgttggcagctgta

SEQ ID NO: 492455 - DNA, 15 bp, Homo sapiens
tgttggcagctgtac

SEQ ID NO: 492456 - DNA, 15 bp, Homo sapiens
gttggcagctgtacc

SEQ ID NO: 492457 - DNA, 15 bp, Homo sapiens
ttggcagctgtaccc

SEQ ID NO: 492458 - DNA, 15 bp, Homo sapiens
tggcagctgtaccct

SEQ ID NO: 492459 - DNA, 15 bp, Homo sapiens
ggcagctgtaccctt

SEQ ID NO: 492460 - DNA, 15 bp, Homo sapiens
gcagctgtaccctta

SEQ ID NO: 492461 - DNA, 15 bp, Homo sapiens
cagctgtacccttat

SEQ ID NO: 492462 - DNA, 15 bp, Homo sapiens
agctgtacccttatg

SEQ ID NO: 492463 - DNA, 15 bp, Homo sapiens
gctgtacccttatgc

SEQ ID NO: 492464 - DNA, 15 bp, Homo sapiens
ctgtacccttatgcc

SEQ ID NO: 492465 - DNA, 15 bp, Homo sapiens
tgtacccttatgcct

SEQ ID NO: 492466 - DNA, 15 bp, Homo sapiens
gtacccttatgcctt

SEQ ID NO: 492467 - DNA, 15 bp, Homo sapiens
tacccttatgccttt

SEQ ID NO: 492468 - DNA, 15 bp, Homo sapiens
acccttatgcctttt

SEQ ID NO: 492469 - DNA, 15 bp, Homo sapiens
cccttatgcctttta

SEQ ID NO: 492470 - DNA, 15 bp, Homo sapiens
ccttatgccttttag

SEQ ID NO: 492471 - DNA, 15 bp, Homo sapiens
cttatgccttttagt

SEQ ID NO: 492472 - DNA, 15 bp, Homo sapiens
ttatgccttttagta

SEQ ID NO: 492473 - DNA, 15 bp, Homo sapiens
tatgccttttagtat

SEQ ID NO: 492474 - DNA, 15 bp, Homo sapiens
atgccttttagtatt

SEQ ID NO: 492475 - DNA, 15 bp, Homo sapiens
tgccttttagtattt

SEQ ID NO: 492476 - DNA, 15 bp, Homo sapiens
gccttttagtatttt

SEQ ID NO: 492477 - DNA, 15 bp, Homo sapiens
ccttttagtattttc

SEQ ID NO: 492478 - DNA, 15 bp, Homo sapiens
cttttagtattttct

SEQ ID NO: 492479 - DNA, 15 bp, Homo sapiens
ttttagtattttcta

SEQ ID NO: 492480 - DNA, 15 bp, Homo sapiens
tttagtattttctat

SEQ ID NO: 492481 - DNA, 15 bp, Homo sapiens
ttagtattttctata

SEQ ID NO: 492482 - DNA, 15 bp, Homo sapiens
tagtattttctataa

SEQ ID NO: 492483 - DNA, 15 bp, Homo sapiens
agtattttctataaa

SEQ ID NO: 492484 - DNA, 15 bp, Homo sapiens
gtattttctataaac

SEQ ID NO: 492485 - DNA, 15 bp, Homo sapiens
tattttctataaacc

SEQ ID NO: 492486 - DNA, 15 bp, Homo sapiens
attttctataaacca

SEQ ID NO: 492487 - DNA, 15 bp, Homo sapiens
ttttctataaaccaa

SEQ ID NO: 492488 - DNA, 15 bp, Homo sapiens
tttctataaaccaaa

SEQ ID NO: 492489 - DNA, 15 bp, Homo sapiens
ttctataaaccaaaa

SEQ ID NO: 492490 - DNA, 15 bp, Homo sapiens
tctataaaccaaaaa

SEQ ID NO: 492491 - DNA, 15 bp, Homo sapiens
ctataaaccaaaaag

SEQ ID NO: 492492 - DNA, 15 bp, Homo sapiens
tataaaccaaaaagt

SEQ ID NO: 492493 - DNA, 15 bp, Homo sapiens
ataaaccaaaaagtg

SEQ ID NO: 492494 - DNA, 15 bp, Homo sapiens
taaaccaaaaagtgt

SEQ ID NO: 492495 - DNA, 15 bp, Homo sapiens
aaaccaaaaagtgta

SEQ ID NO: 492496 - DNA, 15 bp, Homo sapiens
aaccaaaaagtgtat

SEQ ID NO: 492497 - DNA, 15 bp, Homo sapiens
accaaaaagtgtatg

SEQ ID NO: 492498 - DNA, 15 bp, Homo sapiens
ccaaaaagtgtatga

SEQ ID NO: 492499 - DNA, 15 bp, Homo sapiens
caaaaagtgtatgag

SEQ ID NO: 492500 - DNA, 15 bp, Homo sapiens
aaaaagtgtatgaga

SEQ ID NO: 492501 - DNA, 15 bp, Homo sapiens
aaaagtgtatgagac

SEQ ID NO: 492502 - DNA, 15 bp, Homo sapiens
aaagtgtatgagaca

SEQ ID NO: 492503 - DNA, 15 bp, Homo sapiens
aagtgtatgagacag

SEQ ID NO: 492504 - DNA, 15 bp, Homo sapiens
agtgtatgagacagg

SEQ ID NO: 492505 - DNA, 15 bp, Homo sapiens
gtgtatgagacaggt

SEQ ID NO: 492506 - DNA, 15 bp, Homo sapiens
tgtatgagacaggtt

SEQ ID NO: 492507 - DNA, 15 bp, Homo sapiens
gtatgagacaggttt

SEQ ID NO: 492508 - DNA, 15 bp, Homo sapiens
tatgagacaggttta

SEQ ID NO: 492509 - DNA, 15 bp, Homo sapiens
atgagacaggtttac

SEQ ID NO: 492510 - DNA, 15 bp, Homo sapiens
tgagacaggtttact

SEQ ID NO: 492511 - DNA, 15 bp, Homo sapiens
gagacaggtttactt

SEQ ID NO: 492512 - DNA, 15 bp, Homo sapiens
agacaggtttacttt

SEQ ID NO: 492513 - DNA, 15 bp, Homo sapiens
gacaggtttactttg

SEQ ID NO: 492514 - DNA, 15 bp, Homo sapiens
acaggtttactttgc

SEQ ID NO: 492515 - DNA, 15 bp, Homo sapiens
caggtttactttgcc

SEQ ID NO: 492516 - DNA, 15 bp, Homo sapiens
aggtttactttgcca

SEQ ID NO: 492517 - DNA, 15 bp, Homo sapiens
ggtttactttgccaa

SEQ ID NO: 492518 - DNA, 15 bp, Homo sapiens
gtttactttgccaag

SEQ ID NO: 492519 - DNA, 15 bp, Homo sapiens
tttactttgccaagg

SEQ ID NO: 492520 - DNA, 15 bp, Homo sapiens
ttactttgccaaggt

SEQ ID NO: 492521 - DNA, 15 bp, Homo sapiens
tactttgccaaggtt

SEQ ID NO: 492522 - DNA, 15 bp, Homo sapiens
actttgccaaggttg

SEQ ID NO: 492523 - DNA, 15 bp, Homo sapiens
ctttgccaaggttga

SEQ ID NO: 492524 - DNA, 15 bp, Homo sapiens
tttgccaaggttgag

SEQ ID NO: 492525 - DNA, 15 bp, Homo sapiens
ttgccaaggttgagg

SEQ ID NO: 492526 - DNA, 15 bp, Homo sapiens
tgccaaggttgagga

SEQ ID NO: 492527 - DNA, 15 bp, Homo sapiens
gccaaggttgaggac

SEQ ID NO: 492528 - DNA, 15 bp, Homo sapiens
ccaaggttgaggaca

SEQ ID NO: 492529 - DNA, 15 bp, Homo sapiens
caaggttgaggacac

SEQ ID NO: 492530 - DNA, 15 bp, Homo sapiens
aaggttgaggacaca

SEQ ID NO: 492531 - DNA, 15 bp, Homo sapiens
aggttgaggacacac

SEQ ID NO: 492532 - DNA, 15 bp, Homo sapiens
ggttgaggacacacc

SEQ ID NO: 492533 - DNA, 15 bp, Homo sapiens
gttgaggacacacct

SEQ ID NO: 492534 - DNA, 15 bp, Homo sapiens
ttgaggacacacctg

SEQ ID NO: 492535 - DNA, 15 bp, Homo sapiens
tgaggacacacctgg

SEQ ID NO: 492536 - DNA, 15 bp, Homo sapiens
gaggacacacctggg

SEQ ID NO: 492537 - DNA, 15 bp, Homo sapiens
aggacacacctggga

SEQ ID NO: 492538 - DNA, 15 bp, Homo sapiens
ggacacacctgggaa

SEQ ID NO: 492539 - DNA, 15 bp, Homo sapiens
gacacacctgggaaa

SEQ ID NO: 492540 - DNA, 15 bp, Homo sapiens
acacacctgggaaaa

SEQ ID NO: 492541 - DNA, 15 bp, Homo sapiens
cacacctgggaaaaa

SEQ ID NO: 492542 - DNA, 15 bp, Homo sapiens
acacctgggaaaaag

SEQ ID NO: 492543 - DNA, 15 bp, Homo sapiens
cacctgggaaaaaga

SEQ ID NO: 492544 - DNA, 15 bp, Homo sapiens
acctgggaaaaagag

SEQ ID NO: 492545 - DNA, 15 bp, Homo sapiens
cctgggaaaaagaga

SEQ ID NO: 492546 - DNA, 15 bp, Homo sapiens
ctgggaaaaagagag

SEQ ID NO: 492547 - DNA, 15 bp, Homo sapiens
tgggaaaaagagaga

SEQ ID NO: 492548 - DNA, 15 bp, Homo sapiens
gggaaaaagagagat

SEQ ID NO: 492549 - DNA, 15 bp, Homo sapiens
ggaaaaagagagata

SEQ ID NO: 492550 - DNA, 15 bp, Homo sapiens
gaaaaagagagataa

SEQ ID NO: 492551 - DNA, 15 bp, Homo sapiens
aaaaagagagataaa

SEQ ID NO: 492552 - DNA, 15 bp, Homo sapiens
aaaagagagataaat

SEQ ID NO: 492553 - DNA, 15 bp, Homo sapiens
aaagagagataaatt

SEQ ID NO: 492554 - DNA, 15 bp, Homo sapiens
aagagagataaattt

SEQ ID NO: 492555 - DNA, 15 bp, Homo sapiens
agagagataaatttc

SEQ ID NO: 492556 - DNA, 15 bp, Homo sapiens
gagagataaatttca

SEQ ID NO: 492557 - DNA, 15 bp, Homo sapiens
agagataaatttcat

SEQ ID NO: 492558 - DNA, 15 bp, Homo sapiens
gagataaatttcatt

SEQ ID NO: 492559 - DNA, 15 bp, Homo sapiens
agataaatttcatta

SEQ ID NO: 492560 - DNA, 15 bp, Homo sapiens
gataaatttcattag

SEQ ID NO: 492561 - DNA, 15 bp, Homo sapiens
ataaatttcattagg

SEQ ID NO: 492562 - DNA, 15 bp, Homo sapiens
taaatttcattagga

SEQ ID NO: 492563 - DNA, 15 bp, Homo sapiens
aaatttcattaggat

SEQ ID NO: 492564 - DNA, 15 bp, Homo sapiens
aatttcattaggatt

SEQ ID NO: 492565 - DNA, 15 bp, Homo sapiens
atttcattaggattt

SEQ ID NO: 492566 - DNA, 15 bp, Homo sapiens
tttcattaggatttg

SEQ ID NO: 492567 - DNA, 15 bp, Homo sapiens
ttcattaggatttgt

SEQ ID NO: 492568 - DNA, 15 bp, Homo sapiens
tcattaggatttgta

SEQ ID NO: 492569 - DNA, 15 bp, Homo sapiens
cattaggatttgtag

SEQ ID NO: 492570 - DNA, 15 bp, Homo sapiens
attaggatttgtagc

SEQ ID NO: 492571 - DNA, 15 bp, Homo sapiens
ttaggatttgtagcc

SEQ ID NO: 492572 - DNA, 15 bp, Homo sapiens
taggatttgtagcct

SEQ ID NO: 492573 - DNA, 15 bp, Homo sapiens
aggatttgtagcctg

SEQ ID NO: 492574 - DNA, 15 bp, Homo sapiens
ggatttgtagcctgt

SEQ ID NO: 492575 - DNA, 15 bp, Homo sapiens
gatttgtagcctgtt

SEQ ID NO: 492576 - DNA, 15 bp, Homo sapiens
atttgtagcctgttt

SEQ ID NO: 492577 - DNA, 15 bp, Homo sapiens
tttgtagcctgtttt

SEQ ID NO: 492578 - DNA, 15 bp, Homo sapiens
ttgtagcctgttttg

SEQ ID NO: 492579 - DNA, 15 bp, Homo sapiens
tgtagcctgttttgt

SEQ ID NO: 492580 - DNA, 15 bp, Homo sapiens
gtagcctgttttgtt

SEQ ID NO: 492581 - DNA, 15 bp, Homo sapiens
tagcctgttttgttt

SEQ ID NO: 492582 - DNA, 15 bp, Homo sapiens
agcctgttttgtttt

SEQ ID NO: 492583 - DNA, 15 bp, Homo sapiens
gcctgttttgttttg

SEQ ID NO: 492584 - DNA, 15 bp, Homo sapiens
cctgttttgttttgt

SEQ ID NO: 492585 - DNA, 15 bp, Homo sapiens
tgttttgtttttttg

SEQ ID NO: 492586 - DNA, 15 bp, Homo sapiens
gttttgtttttttgt

SEQ ID NO: 492587 - DNA, 15 bp, Homo sapiens
ttttgtttttttgtt

SEQ ID NO: 492588 - DNA, 15 bp, Homo sapiens
tgtttttttgttttg

SEQ ID NO: 492589 - DNA, 15 bp, Homo sapiens
gtttttttgttttgt

SEQ ID NO: 492590 - DNA, 15 bp, Homo sapiens
tttttttgttttgtt

SEQ ID NO: 492591 - DNA, 15 bp, Homo sapiens
tgttttgttttttgt

SEQ ID NO: 492592 - DNA, 15 bp, Homo sapiens
gttttgttttttgtt

SEQ ID NO: 492593 - DNA, 15 bp, Homo sapiens
tgttttttgtttttg

SEQ ID NO: 492594 - DNA, 15 bp, Homo sapiens
gttttttgtttttgt

SEQ ID NO: 492595 - DNA, 15 bp, Homo sapiens
ttttttgtttttgtt

SEQ ID NO: 492596 - DNA, 15 bp, Homo sapiens
tgtttttgttttttc

SEQ ID NO: 492597 - DNA, 15 bp, Homo sapiens
gtttttgttttttcc

SEQ ID NO: 492598 - DNA, 15 bp, Homo sapiens
tttttgttttttccc

SEQ ID NO: 492599 - DNA, 15 bp, Homo sapiens
ttttgttttttccca

SEQ ID NO: 492600 - DNA, 15 bp, Homo sapiens
tttgttttttcccaa

SEQ ID NO: 492601 - DNA, 15 bp, Homo sapiens
ttgttttttcccaaa

SEQ ID NO: 492602 - DNA, 15 bp, Homo sapiens
tgttttttcccaaaa

SEQ ID NO: 492603 - DNA, 15 bp, Homo sapiens
gttttttcccaaaaa

SEQ ID NO: 492604 - DNA, 15 bp, Homo sapiens
ttttttcccaaaaag

SEQ ID NO: 492605 - DNA, 15 bp, Homo sapiens
tttttcccaaaaagg

SEQ ID NO: 492606 - DNA, 15 bp, Homo sapiens
ttttcccaaaaagga

SEQ ID NO: 492607 - DNA, 15 bp, Homo sapiens
tttcccaaaaaggat

SEQ ID NO: 492608 - DNA, 15 bp, Homo sapiens
ttcccaaaaaggatt

SEQ ID NO: 492609 - DNA, 15 bp, Homo sapiens
tcccaaaaaggattt

SEQ ID NO: 492610 - DNA, 15 bp, Homo sapiens
cccaaaaaggatttt

SEQ ID NO: 492611 - DNA, 15 bp, Homo sapiens
ccaaaaaggattttg

SEQ ID NO: 492612 - DNA, 15 bp, Homo sapiens
caaaaaggattttga

SEQ ID NO: 492613 - DNA, 15 bp, Homo sapiens
aaaaaggattttgag

SEQ ID NO: 492614 - DNA, 15 bp, Homo sapiens
aaaaggattttgagg

SEQ ID NO: 492615 - DNA, 15 bp, Homo sapiens
aaaggattttgaggg

SEQ ID NO: 492616 - DNA, 15 bp, Homo sapiens
aaggattttgagggc

SEQ ID NO: 492617 - DNA, 15 bp, Homo sapiens
aggattttgagggct

SEQ ID NO: 492618 - DNA, 15 bp, Homo sapiens
ggattttgagggctt

SEQ ID NO: 492619 - DNA, 15 bp, Homo sapiens
gattttgagggcttc

SEQ ID NO: 492620 - DNA, 15 bp, Homo sapiens
attttgagggcttca

SEQ ID NO: 492621 - DNA, 15 bp, Homo sapiens
ttttgagggcttcac

SEQ ID NO: 492622 - DNA, 15 bp, Homo sapiens
tttgagggcttcaca

SEQ ID NO: 492623 - DNA, 15 bp, Homo sapiens
ttgagggcttcacag

SEQ ID NO: 492624 - DNA, 15 bp, Homo sapiens
tgagggcttcacaga

SEQ ID NO: 492625 - DNA, 15 bp, Homo sapiens
gagggcttcacagaa

SEQ ID NO: 492626 - DNA, 15 bp, Homo sapiens
agggcttcacagaaa

SEQ ID NO: 492627 - DNA, 15 bp, Homo sapiens
gggcttcacagaaac

SEQ ID NO: 492628 - DNA, 15 bp, Homo sapiens
ggcttcacagaaacg

SEQ ID NO: 492629 - DNA, 15 bp, Homo sapiens
gcttcacagaaacga

SEQ ID NO: 492630 - DNA, 15 bp, Homo sapiens
cttcacagaaacgaa

SEQ ID NO: 492631 - DNA, 15 bp, Homo sapiens
ttcacagaaacgaaa

SEQ ID NO: 492632 - DNA, 15 bp, Homo sapiens
tcacagaaacgaaag

SEQ ID NO: 492633 - DNA, 15 bp, Homo sapiens
cacagaaacgaaaga

SEQ ID NO: 492634 - DNA, 15 bp, Homo sapiens
acagaaacgaaagag

SEQ ID NO: 492635 - DNA, 15 bp, Homo sapiens
cagaaacgaaagagc

SEQ ID NO: 492636 - DNA, 15 bp, Homo sapiens
agaaacgaaagagca

SEQ ID NO: 492637 - DNA, 15 bp, Homo sapiens
gaaacgaaagagcag

SEQ ID NO: 492638 - DNA, 15 bp, Homo sapiens
aaacgaaagagcagg

SEQ ID NO: 492639 - DNA, 15 bp, Homo sapiens
aacgaaagagcaggc

SEQ ID NO: 492640 - DNA, 15 bp, Homo sapiens
acgaaagagcaggca

SEQ ID NO: 492641 - DNA, 15 bp, Homo sapiens
cgaaagagcaggcag

SEQ ID NO: 492642 - DNA, 15 bp, Homo sapiens
gaaagagcaggcagg

SEQ ID NO: 492643 - DNA, 15 bp, Homo sapiens
aaagagcaggcagga

SEQ ID NO: 492644 - DNA, 15 bp, Homo sapiens
aagagcaggcaggag

SEQ ID NO: 492645 - DNA, 15 bp, Homo sapiens
agagcaggcaggagg

SEQ ID NO: 492646 - DNA, 15 bp, Homo sapiens
gagcaggcaggaggg

SEQ ID NO: 492647 - DNA, 15 bp, Homo sapiens
agcaggcaggagggg

SEQ ID NO: 492648 - DNA, 15 bp, Homo sapiens
gcaggcaggaggggg

SEQ ID NO: 492649 - DNA, 15 bp, Homo sapiens
caggcaggagggggt

SEQ ID NO: 492650 - DNA, 15 bp, Homo sapiens
aggcaggagggggtg

SEQ ID NO: 492651 - DNA, 15 bp, Homo sapiens
ggcaggagggggtgg

SEQ ID NO: 492652 - DNA, 15 bp, Homo sapiens
gcaggagggggtgga

SEQ ID NO: 492653 - DNA, 15 bp, Homo sapiens
caggagggggtggag

SEQ ID NO: 492654 - DNA, 15 bp, Homo sapiens
aggagggggtggagg

SEQ ID NO: 492655 - DNA, 15 bp, Homo sapiens
ggagggggtggagga

SEQ ID NO: 492656 - DNA, 15 bp, Homo sapiens
gagggggtggaggaa

SEQ ID NO: 492657 - DNA, 15 bp, Homo sapiens
agggggtggaggaac

SEQ ID NO: 492658 - DNA, 15 bp, Homo sapiens
gggggtggaggaaca

SEQ ID NO: 492659 - DNA, 15 bp, Homo sapiens
ggggtggaggaacag

SEQ ID NO: 492660 - DNA, 15 bp, Homo sapiens
gggtggaggaacagt

SEQ ID NO: 492661 - DNA, 15 bp, Homo sapiens
ggtggaggaacagtc

SEQ ID NO: 492662 - DNA, 15 bp, Homo sapiens
gtggaggaacagtca

SEQ ID NO: 492663 - DNA, 15 bp, Homo sapiens
tggaggaacagtcaa

SEQ ID NO: 492664 - DNA, 15 bp, Homo sapiens
ggaggaacagtcaat

SEQ ID NO: 492665 - DNA, 15 bp, Homo sapiens
gaggaacagtcaatt

SEQ ID NO: 492666 - DNA, 15 bp, Homo sapiens
aggaacagtcaatta

SEQ ID NO: 492667 - DNA, 15 bp, Homo sapiens
ggaacagtcaattat

SEQ ID NO: 492668 - DNA, 15 bp, Homo sapiens
gaacagtcaattatg

SEQ ID NO: 492669 - DNA, 15 bp, Homo sapiens
aacagtcaattatgc

SEQ ID NO: 492670 - DNA, 15 bp, Homo sapiens
acagtcaattatgca

SEQ ID NO: 492671 - DNA, 15 bp, Homo sapiens
cagtcaattatgcat

SEQ ID NO: 492672 - DNA, 15 bp, Homo sapiens
agtcaattatgcatt

SEQ ID NO: 492673 - DNA, 15 bp, Homo sapiens
gtcaattatgcattt

SEQ ID NO: 492674 - DNA, 15 bp, Homo sapiens
tcaattatgcatttg

SEQ ID NO: 492675 - DNA, 15 bp, Homo sapiens
caattatgcatttgt

SEQ ID NO: 492676 - DNA, 15 bp, Homo sapiens
aattatgcatttgtc

SEQ ID NO: 492677 - DNA, 15 bp, Homo sapiens
attatgcatttgtct

SEQ ID NO: 492678 - DNA, 15 bp, Homo sapiens
ttatgcatttgtctt

SEQ ID NO: 492679 - DNA, 15 bp, Homo sapiens
tatgcatttgtctta

SEQ ID NO: 492680 - DNA, 15 bp, Homo sapiens
atgcatttgtcttat

SEQ ID NO: 492681 - DNA, 15 bp, Homo sapiens
tgcatttgtcttatg

SEQ ID NO: 492682 - DNA, 15 bp, Homo sapiens
gcatttgtcttatgc

SEQ ID NO: 492683 - DNA, 15 bp, Homo sapiens
catttgtcttatgct

SEQ ID NO: 492684 - DNA, 15 bp, Homo sapiens
atttgtcttatgctc

SEQ ID NO: 492685 - DNA, 15 bp, Homo sapiens
tttgtcttatgctca

SEQ ID NO: 492686 - DNA, 15 bp, Homo sapiens
ttgtcttatgctcag

SEQ ID NO: 492687 - DNA, 15 bp, Homo sapiens
tgtcttatgctcagt

SEQ ID NO: 492688 - DNA, 15 bp, Homo sapiens
gtcttatgctcagta

SEQ ID NO: 492689 - DNA, 15 bp, Homo sapiens
tcttatgctcagtaa

SEQ ID NO: 492690 - DNA, 15 bp, Homo sapiens
cttatgctcagtaaa

SEQ ID NO: 492691 - DNA, 15 bp, Homo sapiens
ttatgctcagtaaat

SEQ ID NO: 492692 - DNA, 15 bp, Homo sapiens
tatgctcagtaaatc

SEQ ID NO: 492693 - DNA, 15 bp, Homo sapiens
atgctcagtaaatct

SEQ ID NO: 492694 - DNA, 15 bp, Homo sapiens
tgctcagtaaatctg

SEQ ID NO: 492695 - DNA, 15 bp, Homo sapiens
gctcagtaaatctgc

SEQ ID NO: 492696 - DNA, 15 bp, Homo sapiens
ctcagtaaatctgcg

SEQ ID NO: 492697 - DNA, 15 bp, Homo sapiens
tcagtaaatctgcgt

SEQ ID NO: 492698 - DNA, 15 bp, Homo sapiens
cagtaaatctgcgtt

SEQ ID NO: 492699 - DNA, 15 bp, Homo sapiens
agtaaatctgcgttt

SEQ ID NO: 492700 - DNA, 15 bp, Homo sapiens
gtaaatctgcgtttt

SEQ ID NO: 492701 - DNA, 15 bp, Homo sapiens
taaatctgcgtttta

SEQ ID NO: 492702 - DNA, 15 bp, Homo sapiens
aaatctgcgttttat

SEQ ID NO: 492703 - DNA, 15 bp, Homo sapiens
aatctgcgttttata

SEQ ID NO: 492704 - DNA, 15 bp, Homo sapiens
atctgcgttttatat

SEQ ID NO: 492705 - DNA, 15 bp, Homo sapiens
tctgcgttttatata

SEQ ID NO: 492706 - DNA, 15 bp, Homo sapiens
ctgcgttttatataa

SEQ ID NO: 492707 - DNA, 15 bp, Homo sapiens
tgcgttttatataat

SEQ ID NO: 492708 - DNA, 15 bp, Homo sapiens
gcgttttatataatt

SEQ ID NO: 492709 - DNA, 15 bp, Homo sapiens
cgttttatataatta

SEQ ID NO: 492710 - DNA, 15 bp, Homo sapiens
gttttatataattaa

SEQ ID NO: 492711 - DNA, 15 bp, Homo sapiens
ttttatataattaag

SEQ ID NO: 492712 - DNA, 15 bp, Homo sapiens
tttatataattaaga

SEQ ID NO: 492713 - DNA, 15 bp, Homo sapiens
ttatataattaagat

SEQ ID NO: 492714 - DNA, 15 bp, Homo sapiens
tatataattaagata

SEQ ID NO: 492715 - DNA, 15 bp, Homo sapiens
atataattaagataa

SEQ ID NO: 492716 - DNA, 15 bp, Homo sapiens
tataattaagataag

SEQ ID NO: 492717 - DNA, 15 bp, Homo sapiens
ataattaagataagg

SEQ ID NO: 492718 - DNA, 15 bp, Homo sapiens
taattaagataaggt

SEQ ID NO: 492719 - DNA, 15 bp, Homo sapiens
aattaagataaggta

SEQ ID NO: 492720 - DNA, 15 bp, Homo sapiens
attaagataaggtat

SEQ ID NO: 492721 - DNA, 15 bp, Homo sapiens
ttaagataaggtatg

SEQ ID NO: 492722 - DNA, 15 bp, Homo sapiens
taagataaggtatgc

SEQ ID NO: 492723 - DNA, 15 bp, Homo sapiens
aagataaggtatgcc

SEQ ID NO: 492724 - DNA, 15 bp, Homo sapiens
agataaggtatgcct

SEQ ID NO: 492725 - DNA, 15 bp, Homo sapiens
gataaggtatgccta

SEQ ID NO: 492726 - DNA, 15 bp, Homo sapiens
ataaggtatgcctag

SEQ ID NO: 492727 - DNA, 15 bp, Homo sapiens
taaggtatgcctaga

SEQ ID NO: 492728 - DNA, 15 bp, Homo sapiens
aaggtatgcctagag

SEQ ID NO: 492729 - DNA, 15 bp, Homo sapiens
aggtatgcctagagt

SEQ ID NO: 492730 - DNA, 15 bp, Homo sapiens
ggtatgcctagagta

SEQ ID NO: 492731 - DNA, 15 bp, Homo sapiens
gtatgcctagagtag

SEQ ID NO: 492732 - DNA, 15 bp, Homo sapiens
tatgcctagagtaga

SEQ ID NO: 492733 - DNA, 15 bp, Homo sapiens
atgcctagagtagaa

SEQ ID NO: 492734 - DNA, 15 bp, Homo sapiens
tgcctagagtagaag

SEQ ID NO: 492735 - DNA, 15 bp, Homo sapiens
gcctagagtagaaga

SEQ ID NO: 492736 - DNA, 15 bp, Homo sapiens
cctagagtagaagaa

SEQ ID NO: 492737 - DNA, 15 bp, Homo sapiens
ctagagtagaagaag

SEQ ID NO: 492738 - DNA, 15 bp, Homo sapiens
tagagtagaagaagc

SEQ ID NO: 492739 - DNA, 15 bp, Homo sapiens
agagtagaagaagca

SEQ ID NO: 492740 - DNA, 15 bp, Homo sapiens
gagtagaagaagcag

SEQ ID NO: 492741 - DNA, 15 bp, Homo sapiens
agtagaagaagcagt

SEQ ID NO: 492742 - DNA, 15 bp, Homo sapiens
gtagaagaagcagtc

SEQ ID NO: 492743 - DNA, 15 bp, Homo sapiens
tagaagaagcagtca

SEQ ID NO: 492744 - DNA, 15 bp, Homo sapiens
agaagaagcagtcaa

SEQ ID NO: 492745 - DNA, 15 bp, Homo sapiens
gaagaagcagtcaag

SEQ ID NO: 492746 - DNA, 15 bp, Homo sapiens
aagaagcagtcaagt

SEQ ID NO: 492747 - DNA, 15 bp, Homo sapiens
agaagcagtcaagta

SEQ ID NO: 492748 - DNA, 15 bp, Homo sapiens
gaagcagtcaagtac

SEQ ID NO: 492749 - DNA, 15 bp, Homo sapiens
aagcagtcaagtaca

SEQ ID NO: 492750 - DNA, 15 bp, Homo sapiens
agcagtcaagtacac

SEQ ID NO: 492751 - DNA, 15 bp, Homo sapiens
gcagtcaagtacaca

SEQ ID NO: 492752 - DNA, 15 bp, Homo sapiens
cagtcaagtacacat

SEQ ID NO: 492753 - DNA, 15 bp, Homo sapiens
agtcaagtacacatt

SEQ ID NO: 492754 - DNA, 15 bp, Homo sapiens
gtcaagtacacattt

SEQ ID NO: 492755 - DNA, 15 bp, Homo sapiens
tcaagtacacatttt

SEQ ID NO: 492756 - DNA, 15 bp, Homo sapiens
caagtacacattttt

SEQ ID NO: 492757 - DNA, 15 bp, Homo sapiens
aagtacacatttttc

SEQ ID NO: 492758 - DNA, 15 bp, Homo sapiens
agtacacatttttct

SEQ ID NO: 492759 - DNA, 15 bp, Homo sapiens
gtacacatttttctc

SEQ ID NO: 492760 - DNA, 15 bp, Homo sapiens
tacacatttttctca

SEQ ID NO: 492761 - DNA, 15 bp, Homo sapiens
acacatttttctcag

SEQ ID NO: 492762 - DNA, 15 bp, Homo sapiens
cacatttttctcagg

SEQ ID NO: 492763 - DNA, 15 bp, Homo sapiens
acatttttctcaggg

SEQ ID NO: 492764 - DNA, 15 bp, Homo sapiens
catttttctcagggt

SEQ ID NO: 492765 - DNA, 15 bp, Homo sapiens
atttttctcagggtg

SEQ ID NO: 492766 - DNA, 15 bp, Homo sapiens
tttttctcagggtgg

SEQ ID NO: 492767 - DNA, 15 bp, Homo sapiens
ttttctcagggtggg

SEQ ID NO: 492768 - DNA, 15 bp, Homo sapiens
tttctcagggtggga

SEQ ID NO: 492769 - DNA, 15 bp, Homo sapiens
ttctcagggtgggag

SEQ ID NO: 492770 - DNA, 15 bp, Homo sapiens
tctcagggtgggagg

SEQ ID NO: 492771 - DNA, 15 bp, Homo sapiens
ctcagggtgggagga

SEQ ID NO: 492772 - DNA, 15 bp, Homo sapiens
tcagggtgggaggag

SEQ ID NO: 492773 - DNA, 15 bp, Homo sapiens
cagggtgggaggaga

SEQ ID NO: 492774 - DNA, 15 bp, Homo sapiens
agggtgggaggagag

SEQ ID NO: 492775 - DNA, 15 bp, Homo sapiens
gggtgggaggagaga

SEQ ID NO: 492776 - DNA, 15 bp, Homo sapiens
ggtgggaggagagat

SEQ ID NO: 492777 - DNA, 15 bp, Homo sapiens
gtgggaggagagatg

SEQ ID NO: 492778 - DNA, 15 bp, Homo sapiens
tgggaggagagatga

SEQ ID NO: 492779 - DNA, 15 bp, Homo sapiens
gggaggagagatgac

SEQ ID NO: 492780 - DNA, 15 bp, Homo sapiens
ggaggagagatgact

SEQ ID NO: 492781 - DNA, 15 bp, Homo sapiens
gaggagagatgactt

SEQ ID NO: 492782 - DNA, 15 bp, Homo sapiens
aggagagatgacttc

SEQ ID NO: 492783 - DNA, 15 bp, Homo sapiens
ggagagatgacttct

SEQ ID NO: 492784 - DNA, 15 bp, Homo sapiens
gagagatgacttcta

SEQ ID NO: 492785 - DNA, 15 bp, Homo sapiens
agagatgacttctag

SEQ ID NO: 492786 - DNA, 15 bp, Homo sapiens
gagatgacttctagt

SEQ ID NO: 492787 - DNA, 15 bp, Homo sapiens
agatgacttctagtc

SEQ ID NO: 492788 - DNA, 15 bp, Homo sapiens
gatgacttctagtcc

SEQ ID NO: 492789 - DNA, 15 bp, Homo sapiens
atgacttctagtcct

SEQ ID NO: 492790 - DNA, 15 bp, Homo sapiens
tgacttctagtcctg

SEQ ID NO: 492791 - DNA, 15 bp, Homo sapiens
gacttctagtcctgc

SEQ ID NO: 492792 - DNA, 15 bp, Homo sapiens
acttctagtcctgcc

SEQ ID NO: 492793 - DNA, 15 bp, Homo sapiens
cttctagtcctgcct

SEQ ID NO: 492794 - DNA, 15 bp, Homo sapiens
ttctagtcctgcctt

SEQ ID NO: 492795 - DNA, 15 bp, Homo sapiens
tctagtcctgccttt

SEQ ID NO: 492796 - DNA, 15 bp, Homo sapiens
ctagtcctgcctttg

SEQ ID NO: 492797 - DNA, 15 bp, Homo sapiens
tagtcctgcctttgt

SEQ ID NO: 492798 - DNA, 15 bp, Homo sapiens
agtcctgcctttgtc

SEQ ID NO: 492799 - DNA, 15 bp, Homo sapiens
gtcctgcctttgtcc

SEQ ID NO: 492800 - DNA, 15 bp, Homo sapiens
tcctgcctttgtcct

SEQ ID NO: 492801 - DNA, 15 bp, Homo sapiens
cctgcctttgtcctg

SEQ ID NO: 492802 - DNA, 15 bp, Homo sapiens
ctgcctttgtcctgt

SEQ ID NO: 492803 - DNA, 15 bp, Homo sapiens
tgcctttgtcctgta

SEQ ID NO: 492804 - DNA, 15 bp, Homo sapiens
gcctttgtcctgtaa

SEQ ID NO: 492805 - DNA, 15 bp, Homo sapiens
cctttgtcctgtaaa

SEQ ID NO: 492806 - DNA, 15 bp, Homo sapiens
ctttgtcctgtaaag

SEQ ID NO: 492807 - DNA, 15 bp, Homo sapiens
tttgtcctgtaaaga

SEQ ID NO: 492808 - DNA, 15 bp, Homo sapiens
ttgtcctgtaaagat

SEQ ID NO: 492809 - DNA, 15 bp, Homo sapiens
tgtcctgtaaagata

SEQ ID NO: 492810 - DNA, 15 bp, Homo sapiens
gtcctgtaaagataa

SEQ ID NO: 492811 - DNA, 15 bp, Homo sapiens
tcctgtaaagataag

SEQ ID NO: 492812 - DNA, 15 bp, Homo sapiens
cctgtaaagataagc

SEQ ID NO: 492813 - DNA, 15 bp, Homo sapiens
ctgtaaagataagct

SEQ ID NO: 492814 - DNA, 15 bp, Homo sapiens
tgtaaagataagctg

SEQ ID NO: 492815 - DNA, 15 bp, Homo sapiens
gtaaagataagctgt

SEQ ID NO: 492816 - DNA, 15 bp, Homo sapiens
taaagataagctgtt

SEQ ID NO: 492817 - DNA, 15 bp, Homo sapiens
aaagataagctgtta

SEQ ID NO: 492818 - DNA, 15 bp, Homo sapiens
aagataagctgttaa

SEQ ID NO: 492819 - DNA, 15 bp, Homo sapiens
agataagctgttaat

SEQ ID NO: 492820 - DNA, 15 bp, Homo sapiens
gataagctgttaatt

SEQ ID NO: 492821 - DNA, 15 bp, Homo sapiens
ataagctgttaattc

SEQ ID NO: 492822 - DNA, 15 bp, Homo sapiens
taagctgttaattca

SEQ ID NO: 492823 - DNA, 15 bp, Homo sapiens
aagctgttaattcac

SEQ ID NO: 492824 - DNA, 15 bp, Homo sapiens
agctgttaattcaca

SEQ ID NO: 492825 - DNA, 15 bp, Homo sapiens
gctgttaattcacat

SEQ ID NO: 492826 - DNA, 15 bp, Homo sapiens
ctgttaattcacatt

SEQ ID NO: 492827 - DNA, 15 bp, Homo sapiens
tgttaattcacattg

SEQ ID NO: 492828 - DNA, 15 bp, Homo sapiens
gttaattcacattgt

SEQ ID NO: 492829 - DNA, 15 bp, Homo sapiens
ttaattcacattgtc

SEQ ID NO: 492830 - DNA, 15 bp, Homo sapiens
taattcacattgtca

SEQ ID NO: 492831 - DNA, 15 bp, Homo sapiens
aattcacattgtcag

SEQ ID NO: 492832 - DNA, 15 bp, Homo sapiens
attcacattgtcagg

SEQ ID NO: 492833 - DNA, 15 bp, Homo sapiens
ttcacattgtcaggg

SEQ ID NO: 492834 - DNA, 15 bp, Homo sapiens
tcacattgtcagggt

SEQ ID NO: 492835 - DNA, 15 bp, Homo sapiens
cacattgtcagggtg

SEQ ID NO: 492836 - DNA, 15 bp, Homo sapiens
acattgtcagggtga

SEQ ID NO: 492837 - DNA, 15 bp, Homo sapiens
cattgtcagggtgaa

SEQ ID NO: 492838 - DNA, 15 bp, Homo sapiens
attgtcagggtgaaa

SEQ ID NO: 492839 - DNA, 15 bp, Homo sapiens
ttgtcagggtgaaat

SEQ ID NO: 492840 - DNA, 15 bp, Homo sapiens
tgtcagggtgaaatt

SEQ ID NO: 492841 - DNA, 15 bp, Homo sapiens
gtcagggtgaaattc

SEQ ID NO: 492842 - DNA, 15 bp, Homo sapiens
tcagggtgaaattca

SEQ ID NO: 492843 - DNA, 15 bp, Homo sapiens
cagggtgaaattcaa

SEQ ID NO: 492844 - DNA, 15 bp, Homo sapiens
agggtgaaattcaac

SEQ ID NO: 492845 - DNA, 15 bp, Homo sapiens
gggtgaaattcaaca

SEQ ID NO: 492846 - DNA, 15 bp, Homo sapiens
ggtgaaattcaacaa

SEQ ID NO: 492847 - DNA, 15 bp, Homo sapiens
gtgaaattcaacaaa

SEQ ID NO: 492848 - DNA, 15 bp, Homo sapiens
tgaaattcaacaaaa

SEQ ID NO: 492849 - DNA, 15 bp, Homo sapiens
gaaattcaacaaaac

SEQ ID NO: 492850 - DNA, 15 bp, Homo sapiens
aaattcaacaaaact

SEQ ID NO: 492851 - DNA, 15 bp, Homo sapiens
aattcaacaaaactc

SEQ ID NO: 492852 - DNA, 15 bp, Homo sapiens
attcaacaaaactct

SEQ ID NO: 492853 - DNA, 15 bp, Homo sapiens
ttcaacaaaactctg

SEQ ID NO: 492854 - DNA, 15 bp, Homo sapiens
tcaacaaaactctgt

SEQ ID NO: 492855 - DNA, 15 bp, Homo sapiens
caacaaaactctgtt

SEQ ID NO: 492856 - DNA, 15 bp, Homo sapiens
aacaaaactctgttt

SEQ ID NO: 492857 - DNA, 15 bp, Homo sapiens
acaaaactctgtttt

SEQ ID NO: 492858 - DNA, 15 bp, Homo sapiens
caaaactctgtttta

SEQ ID NO: 492859 - DNA, 15 bp, Homo sapiens
aaaactctgttttag

SEQ ID NO: 492860 - DNA, 15 bp, Homo sapiens
aaactctgttttagg

SEQ ID NO: 492861 - DNA, 15 bp, Homo sapiens
aactctgttttaggg

SEQ ID NO: 492862 - DNA, 15 bp, Homo sapiens
actctgttttagggt

SEQ ID NO: 492863 - DNA, 15 bp, Homo sapiens
ctctgttttagggta

SEQ ID NO: 492864 - DNA, 15 bp, Homo sapiens
tctgttttagggtaa

SEQ ID NO: 492865 - DNA, 15 bp, Homo sapiens
ctgttttagggtaaa

SEQ ID NO: 492866 - DNA, 15 bp, Homo sapiens
tgttttagggtaaag

SEQ ID NO: 492867 - DNA, 15 bp, Homo sapiens
gttttagggtaaaga

SEQ ID NO: 492868 - DNA, 15 bp, Homo sapiens
ttttagggtaaagat

SEQ ID NO: 492869 - DNA, 15 bp, Homo sapiens
tttagggtaaagatt

SEQ ID NO: 492870 - DNA, 15 bp, Homo sapiens
ttagggtaaagattt

SEQ ID NO: 492871 - DNA, 15 bp, Homo sapiens
tagggtaaagatttg

SEQ ID NO: 492872 - DNA, 15 bp, Homo sapiens
agggtaaagatttgg

SEQ ID NO: 492873 - DNA, 15 bp, Homo sapiens
gggtaaagatttggg

SEQ ID NO: 492874 - DNA, 15 bp, Homo sapiens
ggtaaagatttgggg

SEQ ID NO: 492875 - DNA, 15 bp, Homo sapiens
gtaaagatttgggga

SEQ ID NO: 492876 - DNA, 15 bp, Homo sapiens
taaagatttggggac

SEQ ID NO: 492877 - DNA, 15 bp, Homo sapiens
aaagatttggggacc

SEQ ID NO: 492878 - DNA, 15 bp, Homo sapiens
aagatttggggaccc

SEQ ID NO: 492879 - DNA, 15 bp, Homo sapiens
agatttggggaccct

SEQ ID NO: 492880 - DNA, 15 bp, Homo sapiens
gatttggggaccctt

SEQ ID NO: 492881 - DNA, 15 bp, Homo sapiens
atttggggaccctta

SEQ ID NO: 492882 - DNA, 15 bp, Homo sapiens
tttggggacccttag

SEQ ID NO: 492883 - DNA, 15 bp, Homo sapiens
ttggggacccttaga

SEQ ID NO: 492884 - DNA, 15 bp, Homo sapiens
tggggacccttagaa

SEQ ID NO: 492885 - DNA, 15 bp, Homo sapiens
ggggacccttagaaa

SEQ ID NO: 492886 - DNA, 15 bp, Homo sapiens
gggacccttagaaat

SEQ ID NO: 492887 - DNA, 15 bp, Homo sapiens
ggacccttagaaatt

SEQ ID NO: 492888 - DNA, 15 bp, Homo sapiens
gacccttagaaattt

SEQ ID NO: 492889 - DNA, 15 bp, Homo sapiens
acccttagaaatttc

SEQ ID NO: 492890 - DNA, 15 bp, Homo sapiens
cccttagaaatttcc

SEQ ID NO: 492891 - DNA, 15 bp, Homo sapiens
ccttagaaatttcct

SEQ ID NO: 492892 - DNA, 15 bp, Homo sapiens
ttagaaatttccttg

SEQ ID NO: 492893 - DNA, 15 bp, Homo sapiens
tagaaatttccttgt

SEQ ID NO: 492894 - DNA, 15 bp, Homo sapiens
agaaatttccttgtg

SEQ ID NO: 492895 - DNA, 15 bp, Homo sapiens
gaaatttccttgtga

SEQ ID NO: 492896 - DNA, 15 bp, Homo sapiens
aaatttccttgtgag

SEQ ID NO: 492897 - DNA, 15 bp, Homo sapiens
aatttccttgtgagc

SEQ ID NO: 492898 - DNA, 15 bp, Homo sapiens
atttccttgtgagca

SEQ ID NO: 492899 - DNA, 15 bp, Homo sapiens
tttccttgtgagcaa

SEQ ID NO: 492900 - DNA, 15 bp, Homo sapiens
ttccttgtgagcaat

SEQ ID NO: 492901 - DNA, 15 bp, Homo sapiens
tccttgtgagcaatt

SEQ ID NO: 492902 - DNA, 15 bp, Homo sapiens
ccttgtgagcaattt

SEQ ID NO: 492903 - DNA, 15 bp, Homo sapiens
cttgtgagcaatttg

SEQ ID NO: 492904 - DNA, 15 bp, Homo sapiens
ttgtgagcaatttgt

SEQ ID NO: 492905 - DNA, 15 bp, Homo sapiens
tgtgagcaatttgtg

SEQ ID NO: 492906 - DNA, 15 bp, Homo sapiens
gtgagcaatttgtga

SEQ ID NO: 492907 - DNA, 15 bp, Homo sapiens
tgagcaatttgtgag

SEQ ID NO: 492908 - DNA, 15 bp, Homo sapiens
gagcaatttgtgagg

SEQ ID NO: 492909 - DNA, 15 bp, Homo sapiens
agcaatttgtgaggg

SEQ ID NO: 492910 - DNA, 15 bp, Homo sapiens
gcaatttgtgaggga

SEQ ID NO: 492911 - DNA, 15 bp, Homo sapiens
caatttgtgagggag

SEQ ID NO: 492912 - DNA, 15 bp, Homo sapiens
aatttgtgagggagg

SEQ ID NO: 492913 - DNA, 15 bp, Homo sapiens
atttgtgagggaggt

SEQ ID NO: 492914 - DNA, 15 bp, Homo sapiens
tttgtgagggaggtc

SEQ ID NO: 492915 - DNA, 15 bp, Homo sapiens
ttgtgagggaggtca

SEQ ID NO: 492916 - DNA, 15 bp, Homo sapiens
tgtgagggaggtcac

SEQ ID NO: 492917 - DNA, 15 bp, Homo sapiens
gtgagggaggtcact

SEQ ID NO: 492918 - DNA, 15 bp, Homo sapiens
tgagggaggtcactg

SEQ ID NO: 492919 - DNA, 15 bp, Homo sapiens
gagggaggtcactgg

SEQ ID NO: 492920 - DNA, 15 bp, Homo sapiens
agggaggtcactggc

SEQ ID NO: 492921 - DNA, 15 bp, Homo sapiens
gggaggtcactggcc

SEQ ID NO: 492922 - DNA, 15 bp, Homo sapiens
ggaggtcactggcct

SEQ ID NO: 492923 - DNA, 15 bp, Homo sapiens
gaggtcactggcctt

SEQ ID NO: 492924 - DNA, 15 bp, Homo sapiens
aggtcactggccttc

SEQ ID NO: 492925 - DNA, 15 bp, Homo sapiens
ggtcactggccttct

SEQ ID NO: 492926 - DNA, 15 bp, Homo sapiens
gtcactggccttcta

SEQ ID NO: 492927 - DNA, 15 bp, Homo sapiens
tcactggccttctat

SEQ ID NO: 492928 - DNA, 15 bp, Homo sapiens
cactggccttctatc

SEQ ID NO: 492929 - DNA, 15 bp, Homo sapiens
actggccttctatct

SEQ ID NO: 492930 - DNA, 15 bp, Homo sapiens
ctggccttctatctt

SEQ ID NO: 492931 - DNA, 15 bp, Homo sapiens
tggccttctatcttt

SEQ ID NO: 492932 - DNA, 15 bp, Homo sapiens
ggccttctatctttg

SEQ ID NO: 492933 - DNA, 15 bp, Homo sapiens
gccttctatctttgc

SEQ ID NO: 492934 - DNA, 15 bp, Homo sapiens
ccttctatctttgca

SEQ ID NO: 492935 - DNA, 15 bp, Homo sapiens
cttctatctttgcaa

SEQ ID NO: 492936 - DNA, 15 bp, Homo sapiens
ttctatctttgcaag

SEQ ID NO: 492937 - DNA, 15 bp, Homo sapiens
tctatctttgcaagt

SEQ ID NO: 492938 - DNA, 15 bp, Homo sapiens
ctatctttgcaagta

SEQ ID NO: 492939 - DNA, 15 bp, Homo sapiens
tatctttgcaagtag

SEQ ID NO: 492940 - DNA, 15 bp, Homo sapiens
atctttgcaagtagc

SEQ ID NO: 492941 - DNA, 15 bp, Homo sapiens
tctttgcaagtagct

SEQ ID NO: 492942 - DNA, 15 bp, Homo sapiens
ctttgcaagtagctg

SEQ ID NO: 492943 - DNA, 15 bp, Homo sapiens
tttgcaagtagctgc

SEQ ID NO: 492944 - DNA, 15 bp, Homo sapiens
ttgcaagtagctgct

SEQ ID NO: 492945 - DNA, 15 bp, Homo sapiens
tgcaagtagctgctt

SEQ ID NO: 492946 - DNA, 15 bp, Homo sapiens
gcaagtagctgctta

SEQ ID NO: 492947 - DNA, 15 bp, Homo sapiens
caagtagctgcttag

SEQ ID NO: 492948 - DNA, 15 bp, Homo sapiens
aagtagctgcttagg

SEQ ID NO: 492949 - DNA, 15 bp, Homo sapiens
agtagctgcttagga

SEQ ID NO: 492950 - DNA, 15 bp, Homo sapiens
gtagctgcttaggaa

SEQ ID NO: 492951 - DNA, 15 bp, Homo sapiens
tagctgcttaggaag

SEQ ID NO: 492952 - DNA, 15 bp, Homo sapiens
agctgcttaggaagg

SEQ ID NO: 492953 - DNA, 15 bp, Homo sapiens
gctgcttaggaaggt

SEQ ID NO: 492954 - DNA, 15 bp, Homo sapiens
ctgcttaggaaggta

SEQ ID NO: 492955 - DNA, 15 bp, Homo sapiens
tgcttaggaaggtag

SEQ ID NO: 492956 - DNA, 15 bp, Homo sapiens
gcttaggaaggtagt

SEQ ID NO: 492957 - DNA, 15 bp, Homo sapiens
cttaggaaggtagtt

SEQ ID NO: 492958 - DNA, 15 bp, Homo sapiens
ttaggaaggtagttt

SEQ ID NO: 492959 - DNA, 15 bp, Homo sapiens
taggaaggtagtttt

SEQ ID NO: 492960 - DNA, 15 bp, Homo sapiens
aggaaggtagttttt

SEQ ID NO: 492961 - DNA, 15 bp, Homo sapiens
ggaaggtagtttttg

SEQ ID NO: 492962 - DNA, 15 bp, Homo sapiens
gaaggtagtttttgt

SEQ ID NO: 492963 - DNA, 15 bp, Homo sapiens
aaggtagtttttgtg

SEQ ID NO: 492964 - DNA, 15 bp, Homo sapiens
aggtagtttttgtgt

SEQ ID NO: 492965 - DNA, 15 bp, Homo sapiens
ggtagtttttgtgtg

SEQ ID NO: 492966 - DNA, 15 bp, Homo sapiens
gtagtttttgtgtga

SEQ ID NO: 492967 - DNA, 15 bp, Homo sapiens
tagtttttgtgtgac

SEQ ID NO: 492968 - DNA, 15 bp, Homo sapiens
agtttttgtgtgact

SEQ ID NO: 492969 - DNA, 15 bp, Homo sapiens
gtttttgtgtgactc

SEQ ID NO: 492970 - DNA, 15 bp, Homo sapiens
tttttgtgtgactca

SEQ ID NO: 492971 - DNA, 15 bp, Homo sapiens
ttttgtgtgactcag

SEQ ID NO: 492972 - DNA, 15 bp, Homo sapiens
tttgtgtgactcagt

SEQ ID NO: 492973 - DNA, 15 bp, Homo sapiens
ttgtgtgactcagtt

SEQ ID NO: 492974 - DNA, 15 bp, Homo sapiens
tgtgtgactcagttc

SEQ ID NO: 492975 - DNA, 15 bp, Homo sapiens
gtgtgactcagttcc

SEQ ID NO: 492976 - DNA, 15 bp, Homo sapiens
tgtgactcagttccc

SEQ ID NO: 492977 - DNA, 15 bp, Homo sapiens
gtgactcagttccca

SEQ ID NO: 492978 - DNA, 15 bp, Homo sapiens
tgactcagttcccac

SEQ ID NO: 492979 - DNA, 15 bp, Homo sapiens
gactcagttcccact

SEQ ID NO: 492980 - DNA, 15 bp, Homo sapiens
actcagttcccactt

SEQ ID NO: 492981 - DNA, 15 bp, Homo sapiens
ctcagttcccacttt

SEQ ID NO: 492982 - DNA, 15 bp, Homo sapiens
tcagttcccactttt

SEQ ID NO: 492983 - DNA, 15 bp, Homo sapiens
cagttcccactttta

SEQ ID NO: 492984 - DNA, 15 bp, Homo sapiens
agttcccacttttaa

SEQ ID NO: 492985 - DNA, 15 bp, Homo sapiens
gttcccacttttaat

SEQ ID NO: 492986 - DNA, 15 bp, Homo sapiens
ttcccacttttaatt

SEQ ID NO: 492987 - DNA, 15 bp, Homo sapiens
tcccacttttaattt

SEQ ID NO: 492988 - DNA, 15 bp, Homo sapiens
cccacttttaatttt

SEQ ID NO: 492989 - DNA, 15 bp, Homo sapiens
ccacttttaattttt

SEQ ID NO: 492990 - DNA, 15 bp, Homo sapiens
cacttttaatttttc

SEQ ID NO: 492991 - DNA, 15 bp, Homo sapiens
acttttaatttttcc

SEQ ID NO: 492992 - DNA, 15 bp, Homo sapiens
cttttaatttttccc

SEQ ID NO: 492993 - DNA, 15 bp, Homo sapiens
ttttaatttttccct

SEQ ID NO: 492994 - DNA, 15 bp, Homo sapiens
tttaatttttccctt

SEQ ID NO: 492995 - DNA, 15 bp, Homo sapiens
ttaatttttcccttt

SEQ ID NO: 492996 - DNA, 15 bp, Homo sapiens
taatttttcccttta

SEQ ID NO: 492997 - DNA, 15 bp, Homo sapiens
aatttttccctttag

SEQ ID NO: 492998 - DNA, 15 bp, Homo sapiens
atttttccctttagc

SEQ ID NO: 492999 - DNA, 15 bp, Homo sapiens
tttttccctttagca

SEQ ID NO: 493000 - DNA, 15 bp, Homo sapiens
ttttccctttagcat

SEQ ID NO: 493001 - DNA, 15 bp, Homo sapiens
tttccctttagcata

SEQ ID NO: 493002 - DNA, 15 bp, Homo sapiens
ttccctttagcatag

SEQ ID NO: 493003 - DNA, 15 bp, Homo sapiens
tccctttagcatagt

SEQ ID NO: 493004 - DNA, 15 bp, Homo sapiens
ccctttagcatagtg

SEQ ID NO: 493005 - DNA, 15 bp, Homo sapiens
cctttagcatagtga

SEQ ID NO: 493006 - DNA, 15 bp, Homo sapiens
ctttagcatagtgag

SEQ ID NO: 493007 - DNA, 15 bp, Homo sapiens
tttagcatagtgagt

SEQ ID NO: 493008 - DNA, 15 bp, Homo sapiens
ttagcatagtgagtt

SEQ ID NO: 493009 - DNA, 15 bp, Homo sapiens
tagcatagtgagtta

SEQ ID NO: 493010 - DNA, 15 bp, Homo sapiens
agcatagtgagttag

SEQ ID NO: 493011 - DNA, 15 bp, Homo sapiens
gcatagtgagttagg

SEQ ID NO: 493012 - DNA, 15 bp, Homo sapiens
catagtgagttaggg

SEQ ID NO: 493013 - DNA, 15 bp, Homo sapiens
atagtgagttaggga

SEQ ID NO: 493014 - DNA, 15 bp, Homo sapiens
tagtgagttagggat

SEQ ID NO: 493015 - DNA, 15 bp, Homo sapiens
agtgagttagggatc

SEQ ID NO: 493016 - DNA, 15 bp, Homo sapiens
gtgagttagggatcc

SEQ ID NO: 493017 - DNA, 15 bp, Homo sapiens
tgagttagggatcct

SEQ ID NO: 493018 - DNA, 15 bp, Homo sapiens
gagttagggatcctg

SEQ ID NO: 493019 - DNA, 15 bp, Homo sapiens
agttagggatcctga

SEQ ID NO: 493020 - DNA, 15 bp, Homo sapiens
gttagggatcctgag

SEQ ID NO: 493021 - DNA, 15 bp, Homo sapiens
ttagggatcctgaga

SEQ ID NO: 493022 - DNA, 15 bp, Homo sapiens
tagggatcctgagat

SEQ ID NO: 493023 - DNA, 15 bp, Homo sapiens
agggatcctgagatt

SEQ ID NO: 493024 - DNA, 15 bp, Homo sapiens
gggatcctgagattt

SEQ ID NO: 493025 - DNA, 15 bp, Homo sapiens
ggatcctgagatttt

SEQ ID NO: 493026 - DNA, 15 bp, Homo sapiens
gatcctgagattttg

SEQ ID NO: 493027 - DNA, 15 bp, Homo sapiens
atcctgagattttgt

SEQ ID NO: 493028 - DNA, 15 bp, Homo sapiens
tcctgagattttgtt

SEQ ID NO: 493029 - DNA, 15 bp, Homo sapiens
cctgagattttgttt

SEQ ID NO: 493030 - DNA, 15 bp, Homo sapiens
ctgagattttgtttt

SEQ ID NO: 493031 - DNA, 15 bp, Homo sapiens
tgagattttgttttc

SEQ ID NO: 493032 - DNA, 15 bp, Homo sapiens
gagattttgttttcc

SEQ ID NO: 493033 - DNA, 15 bp, Homo sapiens
agattttgttttcca

SEQ ID NO: 493034 - DNA, 15 bp, Homo sapiens
gattttgttttccat

SEQ ID NO: 493035 - DNA, 15 bp, Homo sapiens
ttttgttttccattc

SEQ ID NO: 493036 - DNA, 15 bp, Homo sapiens
tttgttttccattca

SEQ ID NO: 493037 - DNA, 15 bp, Homo sapiens
ttgttttccattcac

SEQ ID NO: 493038 - DNA, 15 bp, Homo sapiens
tgttttccattcaca

SEQ ID NO: 493039 - DNA, 15 bp, Homo sapiens
gttttccattcacat

SEQ ID NO: 493040 - DNA, 15 bp, Homo sapiens
ttttccattcacatt

SEQ ID NO: 493041 - DNA, 15 bp, Homo sapiens
tttccattcacattt

SEQ ID NO: 493042 - DNA, 15 bp, Homo sapiens
ttccattcacatttt

SEQ ID NO: 493043 - DNA, 15 bp, Homo sapiens
tccattcacattttc

SEQ ID NO: 493044 - DNA, 15 bp, Homo sapiens
ccattcacattttct

SEQ ID NO: 493045 - DNA, 15 bp, Homo sapiens
cattcacattttctt

SEQ ID NO: 493046 - DNA, 15 bp, Homo sapiens
attcacattttctta

SEQ ID NO: 493047 - DNA, 15 bp, Homo sapiens
ttcacattttcttat

SEQ ID NO: 493048 - DNA, 15 bp, Homo sapiens
tcacattttcttatc

SEQ ID NO: 493049 - DNA, 15 bp, Homo sapiens
cacattttcttatca

SEQ ID NO: 493050 - DNA, 15 bp, Homo sapiens
acattttcttatcac

SEQ ID NO: 493051 - DNA, 15 bp, Homo sapiens
cattttcttatcaca

SEQ ID NO: 493052 - DNA, 15 bp, Homo sapiens
attttcttatcacat

SEQ ID NO: 493053 - DNA, 15 bp, Homo sapiens
ttttcttatcacata

SEQ ID NO: 493054 - DNA, 15 bp, Homo sapiens
tttcttatcacatac

SEQ ID NO: 493055 - DNA, 15 bp, Homo sapiens
ttcttatcacatact

SEQ ID NO: 493056 - DNA, 15 bp, Homo sapiens
tcttatcacatactt

SEQ ID NO: 493057 - DNA, 15 bp, Homo sapiens
cttatcacatacttt

SEQ ID NO: 493058 - DNA, 15 bp, Homo sapiens
ttatcacatactttt

SEQ ID NO: 493059 - DNA, 15 bp, Homo sapiens
tatcacatactttta

SEQ ID NO: 493060 - DNA, 15 bp, Homo sapiens
atcacatacttttag

SEQ ID NO: 493061 - DNA, 15 bp, Homo sapiens
tcacatacttttagt

SEQ ID NO: 493062 - DNA, 15 bp, Homo sapiens
cacatacttttagta

SEQ ID NO: 493063 - DNA, 15 bp, Homo sapiens
acatacttttagtaa

SEQ ID NO: 493064 - DNA, 15 bp, Homo sapiens
catacttttagtaat

SEQ ID NO: 493065 - DNA, 15 bp, Homo sapiens
atacttttagtaata

SEQ ID NO: 493066 - DNA, 15 bp, Homo sapiens
tacttttagtaataa

SEQ ID NO: 493067 - DNA, 15 bp, Homo sapiens
acttttagtaataat

SEQ ID NO: 493068 - DNA, 15 bp, Homo sapiens
cttttagtaataatg

SEQ ID NO: 493069 - DNA, 15 bp, Homo sapiens
ttttagtaataatgt

SEQ ID NO: 493070 - DNA, 15 bp, Homo sapiens
tttagtaataatgtg

SEQ ID NO: 493071 - DNA, 15 bp, Homo sapiens
ttagtaataatgtgc

SEQ ID NO: 493072 - DNA, 15 bp, Homo sapiens
tagtaataatgtgcc

SEQ ID NO: 493073 - DNA, 15 bp, Homo sapiens
agtaataatgtgcca

SEQ ID NO: 493074 - DNA, 15 bp, Homo sapiens
gtaataatgtgccac

SEQ ID NO: 493075 - DNA, 15 bp, Homo sapiens
taataatgtgccaca

SEQ ID NO: 493076 - DNA, 15 bp, Homo sapiens
aataatgtgccacaa

SEQ ID NO: 493077 - DNA, 15 bp, Homo sapiens
ataatgtgccacaaa

SEQ ID NO: 493078 - DNA, 15 bp, Homo sapiens
taatgtgccacaaag

SEQ ID NO: 493079 - DNA, 15 bp, Homo sapiens
aatgtgccacaaagc

SEQ ID NO: 493080 - DNA, 15 bp, Homo sapiens
atgtgccacaaagcc

SEQ ID NO: 493081 - DNA, 15 bp, Homo sapiens
tgtgccacaaagcca

SEQ ID NO: 493082 - DNA, 15 bp, Homo sapiens
gtgccacaaagccac

SEQ ID NO: 493083 - DNA, 15 bp, Homo sapiens
tgccacaaagccaca

SEQ ID NO: 493084 - DNA, 15 bp, Homo sapiens
gccacaaagccacag

SEQ ID NO: 493085 - DNA, 15 bp, Homo sapiens
ccacaaagccacagc

SEQ ID NO: 493086 - DNA, 15 bp, Homo sapiens
cacaaagccacagca

SEQ ID NO: 493087 - DNA, 15 bp, Homo sapiens
acaaagccacagcag

SEQ ID NO: 493088 - DNA, 15 bp, Homo sapiens
caaagccacagcagc

SEQ ID NO: 493089 - DNA, 15 bp, Homo sapiens
aaagccacagcagct

SEQ ID NO: 493090 - DNA, 15 bp, Homo sapiens
aagccacagcagctt

SEQ ID NO: 493091 - DNA, 15 bp, Homo sapiens
agccacagcagcttt

SEQ ID NO: 493092 - DNA, 15 bp, Homo sapiens
gccacagcagctttg

SEQ ID NO: 493093 - DNA, 15 bp, Homo sapiens
ccacagcagctttgg

SEQ ID NO: 493094 - DNA, 15 bp, Homo sapiens
cacagcagctttgga

SEQ ID NO: 493095 - DNA, 15 bp, Homo sapiens
acagcagctttggag

SEQ ID NO: 493096 - DNA, 15 bp, Homo sapiens
cagcagctttggaga

SEQ ID NO: 493097 - DNA, 15 bp, Homo sapiens
agcagctttggagaa

SEQ ID NO: 493098 - DNA, 15 bp, Homo sapiens
gcagctttggagaac

SEQ ID NO: 493099 - DNA, 15 bp, Homo sapiens
cagctttggagaaca

SEQ ID NO: 493100 - DNA, 15 bp, Homo sapiens
agctttggagaacat

SEQ ID NO: 493101 - DNA, 15 bp, Homo sapiens
gctttggagaacatt

SEQ ID NO: 493102 - DNA, 15 bp, Homo sapiens
ctttggagaacattt

SEQ ID NO: 493103 - DNA, 15 bp, Homo sapiens
tttggagaacatttt

SEQ ID NO: 493104 - DNA, 15 bp, Homo sapiens
ttggagaacattttc

SEQ ID NO: 493105 - DNA, 15 bp, Homo sapiens
tggagaacattttct

SEQ ID NO: 493106 - DNA, 15 bp, Homo sapiens
ggagaacattttctt

SEQ ID NO: 493107 - DNA, 15 bp, Homo sapiens
gagaacattttcttt

SEQ ID NO: 493108 - DNA, 15 bp, Homo sapiens
agaacattttctttc

SEQ ID NO: 493109 - DNA, 15 bp, Homo sapiens
gaacattttctttca

SEQ ID NO: 493110 - DNA, 15 bp, Homo sapiens
aacattttctttcat

SEQ ID NO: 493111 - DNA, 15 bp, Homo sapiens
acattttctttcatg

SEQ ID NO: 493112 - DNA, 15 bp, Homo sapiens
cattttctttcatga

SEQ ID NO: 493113 - DNA, 15 bp, Homo sapiens
attttctttcatgaa

SEQ ID NO: 493114 - DNA, 15 bp, Homo sapiens
ttttctttcatgaac

SEQ ID NO: 493115 - DNA, 15 bp, Homo sapiens
tttctttcatgaact

SEQ ID NO: 493116 - DNA, 15 bp, Homo sapiens
ttctttcatgaactt

SEQ ID NO: 493117 - DNA, 15 bp, Homo sapiens
tctttcatgaacttg

SEQ ID NO: 493118 - DNA, 15 bp, Homo sapiens
ctttcatgaacttgt

SEQ ID NO: 493119 - DNA, 15 bp, Homo sapiens
tttcatgaacttgtt

SEQ ID NO: 493120 - DNA, 15 bp, Homo sapiens
ttcatgaacttgttt

SEQ ID NO: 493121 - DNA, 15 bp, Homo sapiens
tcatgaacttgttta

SEQ ID NO: 493122 - DNA, 15 bp, Homo sapiens
catgaacttgtttac

SEQ ID NO: 493123 - DNA, 15 bp, Homo sapiens
atgaacttgtttact

SEQ ID NO: 493124 - DNA, 15 bp, Homo sapiens
tgaacttgtttacta

SEQ ID NO: 493125 - DNA, 15 bp, Homo sapiens
gaacttgtttactaa

SEQ ID NO: 493126 - DNA, 15 bp, Homo sapiens
aacttgtttactaat

SEQ ID NO: 493127 - DNA, 15 bp, Homo sapiens
acttgtttactaatc

SEQ ID NO: 493128 - DNA, 15 bp, Homo sapiens
cttgtttactaatct

SEQ ID NO: 493129 - DNA, 15 bp, Homo sapiens
ttgtttactaatctt

SEQ ID NO: 493130 - DNA, 15 bp, Homo sapiens
tgtttactaatcttt

SEQ ID NO: 493131 - DNA, 15 bp, Homo sapiens
gtttactaatctttt

SEQ ID NO: 493132 - DNA, 15 bp, Homo sapiens
tttactaatcttttt

SEQ ID NO: 493133 - DNA, 15 bp, Homo sapiens
ttactaatctttttg

SEQ ID NO: 493134 - DNA, 15 bp, Homo sapiens
tactaatctttttga

SEQ ID NO: 493135 - DNA, 15 bp, Homo sapiens
actaatctttttgaa

SEQ ID NO: 493136 - DNA, 15 bp, Homo sapiens
ctaatctttttgaaa

SEQ ID NO: 493137 - DNA, 15 bp, Homo sapiens
taatctttttgaaac

SEQ ID NO: 493138 - DNA, 15 bp, Homo sapiens
aatctttttgaaaca

SEQ ID NO: 493139 - DNA, 15 bp, Homo sapiens
atctttttgaaacaa

SEQ ID NO: 493140 - DNA, 15 bp, Homo sapiens
tctttttgaaacaat

SEQ ID NO: 493141 - DNA, 15 bp, Homo sapiens
ctttttgaaacaatg

SEQ ID NO: 493142 - DNA, 15 bp, Homo sapiens
tttttgaaacaatga

SEQ ID NO: 493143 - DNA, 15 bp, Homo sapiens
ttttgaaacaatgag

SEQ ID NO: 493144 - DNA, 15 bp, Homo sapiens
tttgaaacaatgagc

SEQ ID NO: 493145 - DNA, 15 bp, Homo sapiens
ttgaaacaatgagcc

SEQ ID NO: 493146 - DNA, 15 bp, Homo sapiens
tgaaacaatgagcct

SEQ ID NO: 493147 - DNA, 15 bp, Homo sapiens
gaaacaatgagcctt

SEQ ID NO: 493148 - DNA, 15 bp, Homo sapiens
aaacaatgagccttc

SEQ ID NO: 493149 - DNA, 15 bp, Homo sapiens
aacaatgagccttct

SEQ ID NO: 493150 - DNA, 15 bp, Homo sapiens
acaatgagccttctg

SEQ ID NO: 493151 - DNA, 15 bp, Homo sapiens
caatgagccttctga

SEQ ID NO: 493152 - DNA, 15 bp, Homo sapiens
aatgagccttctgaa

SEQ ID NO: 493153 - DNA, 15 bp, Homo sapiens
atgagccttctgaat

SEQ ID NO: 493154 - DNA, 15 bp, Homo sapiens
tgagccttctgaatg

SEQ ID NO: 493155 - DNA, 15 bp, Homo sapiens
gagccttctgaatga

SEQ ID NO: 493156 - DNA, 15 bp, Homo sapiens
agccttctgaatgat

SEQ ID NO: 493157 - DNA, 15 bp, Homo sapiens
gccttctgaatgatt

SEQ ID NO: 493158 - DNA, 15 bp, Homo sapiens
ccttctgaatgattg

SEQ ID NO: 493159 - DNA, 15 bp, Homo sapiens
cttctgaatgattgt

SEQ ID NO: 493160 - DNA, 15 bp, Homo sapiens
ttctgaatgattgtc

SEQ ID NO: 493161 - DNA, 15 bp, Homo sapiens
tctgaatgattgtct

SEQ ID NO: 493162 - DNA, 15 bp, Homo sapiens
ctgaatgattgtctt

SEQ ID NO: 493163 - DNA, 15 bp, Homo sapiens
tgaatgattgtctta

SEQ ID NO: 493164 - DNA, 15 bp, Homo sapiens
gaatgattgtcttat

SEQ ID NO: 493165 - DNA, 15 bp, Homo sapiens
aatgattgtcttatt

SEQ ID NO: 493166 - DNA, 15 bp, Homo sapiens
atgattgtcttattg

SEQ ID NO: 493167 - DNA, 15 bp, Homo sapiens
tgattgtcttattgg

SEQ ID NO: 493168 - DNA, 15 bp, Homo sapiens
gattgtcttattggc

SEQ ID NO: 493169 - DNA, 15 bp, Homo sapiens
attgtcttattggca

SEQ ID NO: 493170 - DNA, 15 bp, Homo sapiens
ttgtcttattggcaa

SEQ ID NO: 493171 - DNA, 15 bp, Homo sapiens
tgtcttattggcaag

SEQ ID NO: 493172 - DNA, 15 bp, Homo sapiens
gtcttattggcaaga

SEQ ID NO: 493173 - DNA, 15 bp, Homo sapiens
tcttattggcaagag

SEQ ID NO: 493174 - DNA, 15 bp, Homo sapiens
cttattggcaagaga

SEQ ID NO: 493175 - DNA, 15 bp, Homo sapiens
ttattggcaagagag

SEQ ID NO: 493176 - DNA, 15 bp, Homo sapiens
tattggcaagagagg

SEQ ID NO: 493177 - DNA, 15 bp, Homo sapiens
attggcaagagaggc

SEQ ID NO: 493178 - DNA, 15 bp, Homo sapiens
ttggcaagagaggct

SEQ ID NO: 493179 - DNA, 15 bp, Homo sapiens
tggcaagagaggctg

SEQ ID NO: 493180 - DNA, 15 bp, Homo sapiens
ggcaagagaggctgg

SEQ ID NO: 493181 - DNA, 15 bp, Homo sapiens
gcaagagaggctggg

SEQ ID NO: 493182 - DNA, 15 bp, Homo sapiens
caagagaggctggga

SEQ ID NO: 493183 - DNA, 15 bp, Homo sapiens
aagagaggctgggat

SEQ ID NO: 493184 - DNA, 15 bp, Homo sapiens
agagaggctgggatc

SEQ ID NO: 493185 - DNA, 15 bp, Homo sapiens
gagaggctgggatct

SEQ ID NO: 493186 - DNA, 15 bp, Homo sapiens
agaggctgggatctt

SEQ ID NO: 493187 - DNA, 15 bp, Homo sapiens
gaggctgggatctta

SEQ ID NO: 493188 - DNA, 15 bp, Homo sapiens
aggctgggatcttaa

SEQ ID NO: 493189 - DNA, 15 bp, Homo sapiens
ggctgggatcttaac

SEQ ID NO: 493190 - DNA, 15 bp, Homo sapiens
gctgggatcttaact

SEQ ID NO: 493191 - DNA, 15 bp, Homo sapiens
ctgggatcttaacta

SEQ ID NO: 493192 - DNA, 15 bp, Homo sapiens
tgggatcttaactaa

SEQ ID NO: 493193 - DNA, 15 bp, Homo sapiens
gggatcttaactaaa

SEQ ID NO: 493194 - DNA, 15 bp, Homo sapiens
ggatcttaactaaaa

SEQ ID NO: 493195 - DNA, 15 bp, Homo sapiens
gatcttaactaaaag

SEQ ID NO: 493196 - DNA, 15 bp, Homo sapiens
atcttaactaaaaga

SEQ ID NO: 493197 - DNA, 15 bp, Homo sapiens
tcttaactaaaagac

SEQ ID NO: 493198 - DNA, 15 bp, Homo sapiens
cttaactaaaagaca

SEQ ID NO: 493199 - DNA, 15 bp, Homo sapiens
ttaactaaaagacaa

SEQ ID NO: 493200 - DNA, 15 bp, Homo sapiens
taactaaaagacaag

SEQ ID NO: 493201 - DNA, 15 bp, Homo sapiens
aactaaaagacaagg

SEQ ID NO: 493202 - DNA, 15 bp, Homo sapiens
actaaaagacaaggg

SEQ ID NO: 493203 - DNA, 15 bp, Homo sapiens
ctaaaagacaagggt

SEQ ID NO: 493204 - DNA, 15 bp, Homo sapiens
taaaagacaagggta

SEQ ID NO: 493205 - DNA, 15 bp, Homo sapiens
aaaagacaagggtat

SEQ ID NO: 493206 - DNA, 15 bp, Homo sapiens
aaagacaagggtatg

SEQ ID NO: 493207 - DNA, 15 bp, Homo sapiens
aagacaagggtatgt

SEQ ID NO: 493208 - DNA, 15 bp, Homo sapiens
agacaagggtatgtg

SEQ ID NO: 493209 - DNA, 15 bp, Homo sapiens
gacaagggtatgtga

SEQ ID NO: 493210 - DNA, 15 bp, Homo sapiens
acaagggtatgtgaa

SEQ ID NO: 493211 - DNA, 15 bp, Homo sapiens
caagggtatgtgaag

SEQ ID NO: 493212 - DNA, 15 bp, Homo sapiens
aagggtatgtgaagt

SEQ ID NO: 493213 - DNA, 15 bp, Homo sapiens
agggtatgtgaagta

SEQ ID NO: 493214 - DNA, 15 bp, Homo sapiens
gggtatgtgaagtag

SEQ ID NO: 493215 - DNA, 15 bp, Homo sapiens
ggtatgtgaagtagg

SEQ ID NO: 493216 - DNA, 15 bp, Homo sapiens
gtatgtgaagtaggc

SEQ ID NO: 493217 - DNA, 15 bp, Homo sapiens
tatgtgaagtaggct

SEQ ID NO: 493218 - DNA, 15 bp, Homo sapiens
atgtgaagtaggcta

SEQ ID NO: 493219 - DNA, 15 bp, Homo sapiens
tgtgaagtaggctag

SEQ ID NO: 493220 - DNA, 15 bp, Homo sapiens
gtgaagtaggctagg

SEQ ID NO: 493221 - DNA, 15 bp, Homo sapiens
tgaagtaggctaggg

SEQ ID NO: 493222 - DNA, 15 bp, Homo sapiens
gaagtaggctagggg

SEQ ID NO: 493223 - DNA, 15 bp, Homo sapiens
aagtaggctaggggt

SEQ ID NO: 493224 - DNA, 15 bp, Homo sapiens
agtaggctaggggtg

SEQ ID NO: 493225 - DNA, 15 bp, Homo sapiens
gtaggctaggggtgt

SEQ ID NO: 493226 - DNA, 15 bp, Homo sapiens
taggctaggggtgtg

SEQ ID NO: 493227 - DNA, 15 bp, Homo sapiens
aggctaggggtgtgg

SEQ ID NO: 493228 - DNA, 15 bp, Homo sapiens
ggctaggggtgtggt

SEQ ID NO: 493229 - DNA, 15 bp, Homo sapiens
gctaggggtgtggtg

SEQ ID NO: 493230 - DNA, 15 bp, Homo sapiens
ctaggggtgtggtga

SEQ ID NO: 493231 - DNA, 15 bp, Homo sapiens
taggggtgtggtgag

SEQ ID NO: 493232 - DNA, 15 bp, Homo sapiens
aggggtgtggtgagc

SEQ ID NO: 493233 - DNA, 15 bp, Homo sapiens
ggggtgtggtgagct

SEQ ID NO: 493234 - DNA, 15 bp, Homo sapiens
gggtgtggtgagctg

SEQ ID NO: 493235 - DNA, 15 bp, Homo sapiens
ggtgtggtgagctgt

SEQ ID NO: 493236 - DNA, 15 bp, Homo sapiens
gtgtggtgagctgtg

SEQ ID NO: 493237 - DNA, 15 bp, Homo sapiens
tgtggtgagctgtgg

SEQ ID NO: 493238 - DNA, 15 bp, Homo sapiens
gtggtgagctgtggg

SEQ ID NO: 493239 - DNA, 15 bp, Homo sapiens
tggtgagctgtgggt

SEQ ID NO: 493240 - DNA, 15 bp, Homo sapiens
ggtgagctgtgggtg

SEQ ID NO: 493241 - DNA, 15 bp, Homo sapiens
gtgagctgtgggtgt

SEQ ID NO: 493242 - DNA, 15 bp, Homo sapiens
tgagctgtgggtgtt

SEQ ID NO: 493243 - DNA, 15 bp, Homo sapiens
gagctgtgggtgttc

SEQ ID NO: 493244 - DNA, 15 bp, Homo sapiens
agctgtgggtgttct

SEQ ID NO: 493245 - DNA, 15 bp, Homo sapiens
gctgtgggtgttctc

SEQ ID NO: 493246 - DNA, 15 bp, Homo sapiens
ctgtgggtgttctct

SEQ ID NO: 493247 - DNA, 15 bp, Homo sapiens
tgtgggtgttctctc

SEQ ID NO: 493248 - DNA, 15 bp, Homo sapiens
gtgggtgttctctcc

SEQ ID NO: 493249 - DNA, 15 bp, Homo sapiens
tgggtgttctctcct

SEQ ID NO: 493250 - DNA, 15 bp, Homo sapiens
gggtgttctctcctg

SEQ ID NO: 493251 - DNA, 15 bp, Homo sapiens
ggtgttctctcctgc

SEQ ID NO: 493252 - DNA, 15 bp, Homo sapiens
gtgttctctcctgct

SEQ ID NO: 493253 - DNA, 15 bp, Homo sapiens
tgttctctcctgctt

SEQ ID NO: 493254 - DNA, 15 bp, Homo sapiens
gttctctcctgcttg

SEQ ID NO: 493255 - DNA, 15 bp, Homo sapiens
ttctctcctgcttgc

SEQ ID NO: 493256 - DNA, 15 bp, Homo sapiens
tctctcctgcttgct

SEQ ID NO: 493257 - DNA, 15 bp, Homo sapiens
ctctcctgcttgctt

SEQ ID NO: 493258 - DNA, 15 bp, Homo sapiens
tctcctgcttgcttc

SEQ ID NO: 493259 - DNA, 15 bp, Homo sapiens
ctcctgcttgcttct

SEQ ID NO: 493260 - DNA, 15 bp, Homo sapiens
tcctgcttgcttctg

SEQ ID NO: 493261 - DNA, 15 bp, Homo sapiens
cctgcttgcttctgt

SEQ ID NO: 493262 - DNA, 15 bp, Homo sapiens
ctgcttgcttctgtt

SEQ ID NO: 493263 - DNA, 15 bp, Homo sapiens
tgcttgcttctgttg

SEQ ID NO: 493264 - DNA, 15 bp, Homo sapiens
gcttgcttctgttgt

SEQ ID NO: 493265 - DNA, 15 bp, Homo sapiens
cttgcttctgttgtc

SEQ ID NO: 493266 - DNA, 15 bp, Homo sapiens
ttgcttctgttgtct

SEQ ID NO: 493267 - DNA, 15 bp, Homo sapiens
tgcttctgttgtcta

SEQ ID NO: 493268 - DNA, 15 bp, Homo sapiens
gcttctgttgtctaa

SEQ ID NO: 493269 - DNA, 15 bp, Homo sapiens
cttctgttgtctaag

SEQ ID NO: 493270 - DNA, 15 bp, Homo sapiens
ttctgttgtctaagt

SEQ ID NO: 493271 - DNA, 15 bp, Homo sapiens
tctgttgtctaagtg

SEQ ID NO: 493272 - DNA, 15 bp, Homo sapiens
ctgttgtctaagtga

SEQ ID NO: 493273 - DNA, 15 bp, Homo sapiens
tgttgtctaagtgaa

SEQ ID NO: 493274 - DNA, 15 bp, Homo sapiens
gttgtctaagtgaat

SEQ ID NO: 493275 - DNA, 15 bp, Homo sapiens
ttgtctaagtgaatt

SEQ ID NO: 493276 - DNA, 15 bp, Homo sapiens
tgtctaagtgaattg

SEQ ID NO: 493277 - DNA, 15 bp, Homo sapiens
gtctaagtgaattgg

SEQ ID NO: 493278 - DNA, 15 bp, Homo sapiens
tctaagtgaattgga

SEQ ID NO: 493279 - DNA, 15 bp, Homo sapiens
ctaagtgaattggaa

SEQ ID NO: 493280 - DNA, 15 bp, Homo sapiens
taagtgaattggaag

SEQ ID NO: 493281 - DNA, 15 bp, Homo sapiens
aagtgaattggaagc

SEQ ID NO: 493282 - DNA, 15 bp, Homo sapiens
agtgaattggaagcc

SEQ ID NO: 493283 - DNA, 15 bp, Homo sapiens
gtgaattggaagccg

SEQ ID NO: 493284 - DNA, 15 bp, Homo sapiens
tgaattggaagccgg

SEQ ID NO: 493285 - DNA, 15 bp, Homo sapiens
gaattggaagccggg

SEQ ID NO: 493286 - DNA, 15 bp, Homo sapiens
aattggaagccggga

SEQ ID NO: 493287 - DNA, 15 bp, Homo sapiens
attggaagccgggac

SEQ ID NO: 493288 - DNA, 15 bp, Homo sapiens
ttggaagccgggact

SEQ ID NO: 493289 - DNA, 15 bp, Homo sapiens
tggaagccgggactt

SEQ ID NO: 493290 - DNA, 15 bp, Homo sapiens
ggaagccgggacttt

SEQ ID NO: 493291 - DNA, 15 bp, Homo sapiens
gaagccgggacttta

SEQ ID NO: 493292 - DNA, 15 bp, Homo sapiens
aagccgggactttag

SEQ ID NO: 493293 - DNA, 15 bp, Homo sapiens
agccgggactttagc

SEQ ID NO: 493294 - DNA, 15 bp, Homo sapiens
gccgggactttagca

SEQ ID NO: 493295 - DNA, 15 bp, Homo sapiens
ccgggactttagcag

SEQ ID NO: 493296 - DNA, 15 bp, Homo sapiens
cgggactttagcagg

SEQ ID NO: 493297 - DNA, 15 bp, Homo sapiens
gggactttagcaggg

SEQ ID NO: 493298 - DNA, 15 bp, Homo sapiens
ggactttagcaggga

SEQ ID NO: 493299 - DNA, 15 bp, Homo sapiens
gactttagcagggag

SEQ ID NO: 493300 - DNA, 15 bp, Homo sapiens
actttagcagggagt

SEQ ID NO: 493301 - DNA, 15 bp, Homo sapiens
ctttagcagggagtg

SEQ ID NO: 493302 - DNA, 15 bp, Homo sapiens
tttagcagggagtga

SEQ ID NO: 493303 - DNA, 15 bp, Homo sapiens
ttagcagggagtgag

SEQ ID NO: 493304 - DNA, 15 bp, Homo sapiens
tagcagggagtgagg

SEQ ID NO: 493305 - DNA, 15 bp, Homo sapiens
agcagggagtgaggt

SEQ ID NO: 493306 - DNA, 15 bp, Homo sapiens
gcagggagtgaggtt

SEQ ID NO: 493307 - DNA, 15 bp, Homo sapiens
cagggagtgaggttg

SEQ ID NO: 493308 - DNA, 15 bp, Homo sapiens
agggagtgaggttgg

SEQ ID NO: 493309 - DNA, 15 bp, Homo sapiens
gggagtgaggttggg

SEQ ID NO: 493310 - DNA, 15 bp, Homo sapiens
ggagtgaggttgggg

SEQ ID NO: 493311 - DNA, 15 bp, Homo sapiens
gagtgaggttgggga

SEQ ID NO: 493312 - DNA, 15 bp, Homo sapiens
agtgaggttggggag

SEQ ID NO: 493313 - DNA, 15 bp, Homo sapiens
gtgaggttggggagg

SEQ ID NO: 493314 - DNA, 15 bp, Homo sapiens
tgaggttggggagga

SEQ ID NO: 493315 - DNA, 15 bp, Homo sapiens
gaggttggggaggag

SEQ ID NO: 493316 - DNA, 15 bp, Homo sapiens
aggttggggaggagg

SEQ ID NO: 493317 - DNA, 15 bp, Homo sapiens
ggttggggaggaggt

SEQ ID NO: 493318 - DNA, 15 bp, Homo sapiens
gttggggaggaggtg

SEQ ID NO: 493319 - DNA, 15 bp, Homo sapiens
ttggggaggaggtgt

SEQ ID NO: 493320 - DNA, 15 bp, Homo sapiens
tggggaggaggtgtc

SEQ ID NO: 493321 - DNA, 15 bp, Homo sapiens
ggggaggaggtgtca

SEQ ID NO: 493322 - DNA, 15 bp, Homo sapiens
gggaggaggtgtcag

SEQ ID NO: 493323 - DNA, 15 bp, Homo sapiens
ggaggaggtgtcaga

SEQ ID NO: 493324 - DNA, 15 bp, Homo sapiens
gaggaggtgtcagaa

SEQ ID NO: 493325 - DNA, 15 bp, Homo sapiens
aggaggtgtcagaag

SEQ ID NO: 493326 - DNA, 15 bp, Homo sapiens
ggaggtgtcagaagt

SEQ ID NO: 493327 - DNA, 15 bp, Homo sapiens
gaggtgtcagaagtg

SEQ ID NO: 493328 - DNA, 15 bp, Homo sapiens
aggtgtcagaagtgc

SEQ ID NO: 493329 - DNA, 15 bp, Homo sapiens
ggtgtcagaagtgcg

SEQ ID NO: 493330 - DNA, 15 bp, Homo sapiens
gtgtcagaagtgcga

SEQ ID NO: 493331 - DNA, 15 bp, Homo sapiens
tgtcagaagtgcgag

SEQ ID NO: 493332 - DNA, 15 bp, Homo sapiens
gtcagaagtgcgagg

SEQ ID NO: 493333 - DNA, 15 bp, Homo sapiens
tcagaagtgcgagga

SEQ ID NO: 493334 - DNA, 15 bp, Homo sapiens
cagaagtgcgaggag

SEQ ID NO: 493335 - DNA, 15 bp, Homo sapiens
agaagtgcgaggaga

SEQ ID NO: 493336 - DNA, 15 bp, Homo sapiens
gaagtgcgaggagag

SEQ ID NO: 493337 - DNA, 15 bp, Homo sapiens
aagtgcgaggagaga

SEQ ID NO: 493338 - DNA, 15 bp, Homo sapiens
agtgcgaggagagac

SEQ ID NO: 493339 - DNA, 15 bp, Homo sapiens
gtgcgaggagagact

SEQ ID NO: 493340 - DNA, 15 bp, Homo sapiens
tgcgaggagagactg

SEQ ID NO: 493341 - DNA, 15 bp, Homo sapiens
gcgaggagagactgg

SEQ ID NO: 493342 - DNA, 15 bp, Homo sapiens
cgaggagagactgga

SEQ ID NO: 493343 - DNA, 15 bp, Homo sapiens
gaggagagactggag

SEQ ID NO: 493344 - DNA, 15 bp, Homo sapiens
aggagagactggagg

SEQ ID NO: 493345 - DNA, 15 bp, Homo sapiens
ggagagactggagga

SEQ ID NO: 493346 - DNA, 15 bp, Homo sapiens
gagagactggaggat

SEQ ID NO: 493347 - DNA, 15 bp, Homo sapiens
agagactggaggatg

SEQ ID NO: 493348 - DNA, 15 bp, Homo sapiens
gagactggaggatgt

SEQ ID NO: 493349 - DNA, 15 bp, Homo sapiens
agactggaggatgtg

SEQ ID NO: 493350 - DNA, 15 bp, Homo sapiens
gactggaggatgtgt

SEQ ID NO: 493351 - DNA, 15 bp, Homo sapiens
actggaggatgtgtg

SEQ ID NO: 493352 - DNA, 15 bp, Homo sapiens
ctggaggatgtgtga

SEQ ID NO: 493353 - DNA, 15 bp, Homo sapiens
tggaggatgtgtgat

SEQ ID NO: 493354 - DNA, 15 bp, Homo sapiens
ggaggatgtgtgata

SEQ ID NO: 493355 - DNA, 15 bp, Homo sapiens
gaggatgtgtgatag

SEQ ID NO: 493356 - DNA, 15 bp, Homo sapiens
aggatgtgtgatagc

SEQ ID NO: 493357 - DNA, 15 bp, Homo sapiens
ggatgtgtgatagct

SEQ ID NO: 493358 - DNA, 15 bp, Homo sapiens
gatgtgtgatagctt

SEQ ID NO: 493359 - DNA, 15 bp, Homo sapiens
atgtgtgatagcttc

SEQ ID NO: 493360 - DNA, 15 bp, Homo sapiens
tgtgtgatagcttct

SEQ ID NO: 493361 - DNA, 15 bp, Homo sapiens
gtgtgatagcttctt

SEQ ID NO: 493362 - DNA, 15 bp, Homo sapiens
tgtgatagcttcttg

SEQ ID NO: 493363 - DNA, 15 bp, Homo sapiens
gtgatagcttcttgg

SEQ ID NO: 493364 - DNA, 15 bp, Homo sapiens
tgatagcttcttgga

SEQ ID NO: 493365 - DNA, 15 bp, Homo sapiens
gatagcttcttggag

SEQ ID NO: 493366 - DNA, 15 bp, Homo sapiens
atagcttcttggaga

SEQ ID NO: 493367 - DNA, 15 bp, Homo sapiens
tagcttcttggagaa

SEQ ID NO: 493368 - DNA, 15 bp, Homo sapiens
agcttcttggagaat

SEQ ID NO: 493369 - DNA, 15 bp, Homo sapiens
gcttcttggagaata

SEQ ID NO: 493370 - DNA, 15 bp, Homo sapiens
cttcttggagaatag

SEQ ID NO: 493371 - DNA, 15 bp, Homo sapiens
ttcttggagaataga

SEQ ID NO: 493372 - DNA, 15 bp, Homo sapiens
tcttggagaatagaa

SEQ ID NO: 493373 - DNA, 15 bp, Homo sapiens
cttggagaatagaag

SEQ ID NO: 493374 - DNA, 15 bp, Homo sapiens
ttggagaatagaaga

SEQ ID NO: 493375 - DNA, 15 bp, Homo sapiens
tggagaatagaagag

SEQ ID NO: 493376 - DNA, 15 bp, Homo sapiens
ggagaatagaagagc

SEQ ID NO: 493377 - DNA, 15 bp, Homo sapiens
gagaatagaagagca

SEQ ID NO: 493378 - DNA, 15 bp, Homo sapiens
agaatagaagagcag

SEQ ID NO: 493379 - DNA, 15 bp, Homo sapiens
gaatagaagagcaga

SEQ ID NO: 493380 - DNA, 15 bp, Homo sapiens
aatagaagagcagat

SEQ ID NO: 493381 - DNA, 15 bp, Homo sapiens
atagaagagcagatg

SEQ ID NO: 493382 - DNA, 15 bp, Homo sapiens
tagaagagcagatgg

SEQ ID NO: 493383 - DNA, 15 bp, Homo sapiens
agaagagcagatggc

SEQ ID NO: 493384 - DNA, 15 bp, Homo sapiens
gaagagcagatggcc

SEQ ID NO: 493385 - DNA, 15 bp, Homo sapiens
aagagcagatggcct

SEQ ID NO: 493386 - DNA, 15 bp, Homo sapiens
agagcagatggcctg

SEQ ID NO: 493387 - DNA, 15 bp, Homo sapiens
gagcagatggcctgg

SEQ ID NO: 493388 - DNA, 15 bp, Homo sapiens
agcagatggcctggg

SEQ ID NO: 493389 - DNA, 15 bp, Homo sapiens
gcagatggcctggga

SEQ ID NO: 493390 - DNA, 15 bp, Homo sapiens
cagatggcctgggaa

SEQ ID NO: 493391 - DNA, 15 bp, Homo sapiens
agatggcctgggaaa

SEQ ID NO: 493392 - DNA, 15 bp, Homo sapiens
gatggcctgggaaat

SEQ ID NO: 493393 - DNA, 15 bp, Homo sapiens
atggcctgggaaata

SEQ ID NO: 493394 - DNA, 15 bp, Homo sapiens
tggcctgggaaatag

SEQ ID NO: 493395 - DNA, 15 bp, Homo sapiens
ggcctgggaaataga

SEQ ID NO: 493396 - DNA, 15 bp, Homo sapiens
gcctgggaaatagag

SEQ ID NO: 493397 - DNA, 15 bp, Homo sapiens
cctgggaaatagagt

SEQ ID NO: 493398 - DNA, 15 bp, Homo sapiens
ctgggaaatagagtg

SEQ ID NO: 493399 - DNA, 15 bp, Homo sapiens
tgggaaatagagtgt

SEQ ID NO: 493400 - DNA, 15 bp, Homo sapiens
gggaaatagagtgtg

SEQ ID NO: 493401 - DNA, 15 bp, Homo sapiens
ggaaatagagtgtga

SEQ ID NO: 493402 - DNA, 15 bp, Homo sapiens
gaaatagagtgtgac

SEQ ID NO: 493403 - DNA, 15 bp, Homo sapiens
aaatagagtgtgact

SEQ ID NO: 493404 - DNA, 15 bp, Homo sapiens
aatagagtgtgacta

SEQ ID NO: 493405 - DNA, 15 bp, Homo sapiens
atagagtgtgactat

SEQ ID NO: 493406 - DNA, 15 bp, Homo sapiens
tagagtgtgactata

SEQ ID NO: 493407 - DNA, 15 bp, Homo sapiens
agagtgtgactataa

SEQ ID NO: 493408 - DNA, 15 bp, Homo sapiens
gagtgtgactataag

SEQ ID NO: 493409 - DNA, 15 bp, Homo sapiens
agtgtgactataagc

SEQ ID NO: 493410 - DNA, 15 bp, Homo sapiens
gtgtgactataagca

SEQ ID NO: 493411 - DNA, 15 bp, Homo sapiens
tgtgactataagcag

SEQ ID NO: 493412 - DNA, 15 bp, Homo sapiens
gtgactataagcagc

SEQ ID NO: 493413 - DNA, 15 bp, Homo sapiens
tgactataagcagca

SEQ ID NO: 493414 - DNA, 15 bp, Homo sapiens
gactataagcagcat

SEQ ID NO: 493415 - DNA, 15 bp, Homo sapiens
actataagcagcatt

SEQ ID NO: 493416 - DNA, 15 bp, Homo sapiens
ctataagcagcatta

SEQ ID NO: 493417 - DNA, 15 bp, Homo sapiens
tataagcagcattaa

SEQ ID NO: 493418 - DNA, 15 bp, Homo sapiens
ataagcagcattaaa

SEQ ID NO: 493419 - DNA, 15 bp, Homo sapiens
taagcagcattaaag

SEQ ID NO: 493420 - DNA, 15 bp, Homo sapiens
aagcagcattaaagg

SEQ ID NO: 493421 - DNA, 15 bp, Homo sapiens
agcagcattaaaggt

SEQ ID NO: 493422 - DNA, 15 bp, Homo sapiens
gcagcattaaaggtg

SEQ ID NO: 493423 - DNA, 15 bp, Homo sapiens
cagcattaaaggtgc

SEQ ID NO: 493424 - DNA, 15 bp, Homo sapiens
agcattaaaggtgcc

SEQ ID NO: 493425 - DNA, 15 bp, Homo sapiens
gcattaaaggtgcca

SEQ ID NO: 493426 - DNA, 15 bp, Homo sapiens
cattaaaggtgccac

SEQ ID NO: 493427 - DNA, 15 bp, Homo sapiens
attaaaggtgccact

SEQ ID NO: 493428 - DNA, 15 bp, Homo sapiens
ttaaaggtgccactc

SEQ ID NO: 493429 - DNA, 15 bp, Homo sapiens
taaaggtgccactca

SEQ ID NO: 493430 - DNA, 15 bp, Homo sapiens
aaaggtgccactcat

SEQ ID NO: 493431 - DNA, 15 bp, Homo sapiens
aaggtgccactcatg

SEQ ID NO: 493432 - DNA, 15 bp, Homo sapiens
aggtgccactcatga

SEQ ID NO: 493433 - DNA, 15 bp, Homo sapiens
ggtgccactcatgaa

SEQ ID NO: 493434 - DNA, 15 bp, Homo sapiens
gtgccactcatgaat

SEQ ID NO: 493435 - DNA, 15 bp, Homo sapiens
tgccactcatgaatt

SEQ ID NO: 493436 - DNA, 15 bp, Homo sapiens
gccactcatgaattt

SEQ ID NO: 493437 - DNA, 15 bp, Homo sapiens
ccactcatgaattta

SEQ ID NO: 493438 - DNA, 15 bp, Homo sapiens
cactcatgaatttaa

SEQ ID NO: 493439 - DNA, 15 bp, Homo sapiens
actcatgaatttaac

SEQ ID NO: 493440 - DNA, 15 bp, Homo sapiens
ctcatgaatttaaca

SEQ ID NO: 493441 - DNA, 15 bp, Homo sapiens
tcatgaatttaacat

SEQ ID NO: 493442 - DNA, 15 bp, Homo sapiens
catgaatttaacatg

SEQ ID NO: 493443 - DNA, 15 bp, Homo sapiens
atgaatttaacatga

SEQ ID NO: 493444 - DNA, 15 bp, Homo sapiens
tgaatttaacatgag

SEQ ID NO: 493445 - DNA, 15 bp, Homo sapiens
gaatttaacatgagg

SEQ ID NO: 493446 - DNA, 15 bp, Homo sapiens
aatttaacatgaggc

SEQ ID NO: 493447 - DNA, 15 bp, Homo sapiens
atttaacatgaggcc

SEQ ID NO: 493448 - DNA, 15 bp, Homo sapiens
tttaacatgaggcca

SEQ ID NO: 493449 - DNA, 15 bp, Homo sapiens
ttaacatgaggccat

SEQ ID NO: 493450 - DNA, 15 bp, Homo sapiens
taacatgaggccatt

SEQ ID NO: 493451 - DNA, 15 bp, Homo sapiens
aacatgaggccattc

SEQ ID NO: 493452 - DNA, 15 bp, Homo sapiens
acatgaggccattct

SEQ ID NO: 493453 - DNA, 15 bp, Homo sapiens
catgaggccattctg

SEQ ID NO: 493454 - DNA, 15 bp, Homo sapiens
atgaggccattctgc

SEQ ID NO: 493455 - DNA, 15 bp, Homo sapiens
tgaggccattctgca

SEQ ID NO: 493456 - DNA, 15 bp, Homo sapiens
gaggccattctgcag

SEQ ID NO: 493457 - DNA, 15 bp, Homo sapiens
aggccattctgcagg

SEQ ID NO: 493458 - DNA, 15 bp, Homo sapiens
ggccattctgcaggg

SEQ ID NO: 493459 - DNA, 15 bp, Homo sapiens
gccattctgcagggt

SEQ ID NO: 493460 - DNA, 15 bp, Homo sapiens
ccattctgcagggtt

SEQ ID NO: 493461 - DNA, 15 bp, Homo sapiens
cattctgcagggttg

SEQ ID NO: 493462 - DNA, 15 bp, Homo sapiens
attctgcagggttgt

SEQ ID NO: 493463 - DNA, 15 bp, Homo sapiens
ttctgcagggttgta

SEQ ID NO: 493464 - DNA, 15 bp, Homo sapiens
tctgcagggttgtaa

SEQ ID NO: 493465 - DNA, 15 bp, Homo sapiens
ctgcagggttgtaag

SEQ ID NO: 493466 - DNA, 15 bp, Homo sapiens
tgcagggttgtaagt

SEQ ID NO: 493467 - DNA, 15 bp, Homo sapiens
gcagggttgtaagtt

SEQ ID NO: 493468 - DNA, 15 bp, Homo sapiens
cagggttgtaagttg

SEQ ID NO: 493469 - DNA, 15 bp, Homo sapiens
agggttgtaagttgc

SEQ ID NO: 493470 - DNA, 15 bp, Homo sapiens
gggttgtaagttgcc

SEQ ID NO: 493471 - DNA, 15 bp, Homo sapiens
ggttgtaagttgccc

SEQ ID NO: 493472 - DNA, 15 bp, Homo sapiens
gttgtaagttgccct

SEQ ID NO: 493473 - DNA, 15 bp, Homo sapiens
ttgtaagttgccctc

SEQ ID NO: 493474 - DNA, 15 bp, Homo sapiens
tgtaagttgccctct

SEQ ID NO: 493475 - DNA, 15 bp, Homo sapiens
gtaagttgccctcta

SEQ ID NO: 493476 - DNA, 15 bp, Homo sapiens
taagttgccctctag

SEQ ID NO: 493477 - DNA, 15 bp, Homo sapiens
aagttgccctctagg

SEQ ID NO: 493478 - DNA, 15 bp, Homo sapiens
agttgccctctaggc

SEQ ID NO: 493479 - DNA, 15 bp, Homo sapiens
gttgccctctaggca

SEQ ID NO: 493480 - DNA, 15 bp, Homo sapiens
ttgccctctaggcat

SEQ ID NO: 493481 - DNA, 15 bp, Homo sapiens
tgccctctaggcata

SEQ ID NO: 493482 - DNA, 15 bp, Homo sapiens
gccctctaggcatat

SEQ ID NO: 493483 - DNA, 15 bp, Homo sapiens
ccctctaggcatatt

SEQ ID NO: 493484 - DNA, 15 bp, Homo sapiens
cctctaggcatattc

SEQ ID NO: 493485 - DNA, 15 bp, Homo sapiens
ctctaggcatattca

SEQ ID NO: 493486 - DNA, 15 bp, Homo sapiens
tctaggcatattcac

SEQ ID NO: 493487 - DNA, 15 bp, Homo sapiens
ctaggcatattcacg

SEQ ID NO: 493488 - DNA, 15 bp, Homo sapiens
taggcatattcacgt

SEQ ID NO: 493489 - DNA, 15 bp, Homo sapiens
aggcatattcacgtt

SEQ ID NO: 493490 - DNA, 15 bp, Homo sapiens
ggcatattcacgttc

SEQ ID NO: 493491 - DNA, 15 bp, Homo sapiens
gcatattcacgttca

SEQ ID NO: 493492 - DNA, 15 bp, Homo sapiens
catattcacgttcat

SEQ ID NO: 493493 - DNA, 15 bp, Homo sapiens
atattcacgttcatg

SEQ ID NO: 493494 - DNA, 15 bp, Homo sapiens
tattcacgttcatga

SEQ ID NO: 493495 - DNA, 15 bp, Homo sapiens
attcacgttcatgag

SEQ ID NO: 493496 - DNA, 15 bp, Homo sapiens
ttcacgttcatgagc

SEQ ID NO: 493497 - DNA, 15 bp, Homo sapiens
tcacgttcatgagca

SEQ ID NO: 493498 - DNA, 15 bp, Homo sapiens
cacgttcatgagcac

SEQ ID NO: 493499 - DNA, 15 bp, Homo sapiens
acgttcatgagcaca

SEQ ID NO: 493500 - DNA, 15 bp, Homo sapiens
cgttcatgagcacag

SEQ ID NO: 493501 - DNA, 15 bp, Homo sapiens
gttcatgagcacagg

SEQ ID NO: 493502 - DNA, 15 bp, Homo sapiens
ttcatgagcacaggc

SEQ ID NO: 493503 - DNA, 15 bp, Homo sapiens
tcatgagcacaggca

SEQ ID NO: 493504 - DNA, 15 bp, Homo sapiens
catgagcacaggcac

SEQ ID NO: 493505 - DNA, 15 bp, Homo sapiens
atgagcacaggcacc

SEQ ID NO: 493506 - DNA, 15 bp, Homo sapiens
tgagcacaggcacca

SEQ ID NO: 493507 - DNA, 15 bp, Homo sapiens
gagcacaggcaccag

SEQ ID NO: 493508 - DNA, 15 bp, Homo sapiens
agcacaggcaccaga

SEQ ID NO: 493509 - DNA, 15 bp, Homo sapiens
gcacaggcaccagaa

SEQ ID NO: 493510 - DNA, 15 bp, Homo sapiens
cacaggcaccagaat

SEQ ID NO: 493511 - DNA, 15 bp, Homo sapiens
acaggcaccagaatg

SEQ ID NO: 493512 - DNA, 15 bp, Homo sapiens
caggcaccagaatgg

SEQ ID NO: 493513 - DNA, 15 bp, Homo sapiens
aggcaccagaatggg

SEQ ID NO: 493514 - DNA, 15 bp, Homo sapiens
ggcaccagaatgggc

SEQ ID NO: 493515 - DNA, 15 bp, Homo sapiens
gcaccagaatgggct

SEQ ID NO: 493516 - DNA, 15 bp, Homo sapiens
caccagaatgggctg

SEQ ID NO: 493517 - DNA, 15 bp, Homo sapiens
accagaatgggctga

SEQ ID NO: 493518 - DNA, 15 bp, Homo sapiens
ccagaatgggctgag

SEQ ID NO: 493519 - DNA, 15 bp, Homo sapiens
cagaatgggctgagt

SEQ ID NO: 493520 - DNA, 15 bp, Homo sapiens
agaatgggctgagta

SEQ ID NO: 493521 - DNA, 15 bp, Homo sapiens
gaatgggctgagtat

SEQ ID NO: 493522 - DNA, 15 bp, Homo sapiens
aatgggctgagtatt

SEQ ID NO: 493523 - DNA, 15 bp, Homo sapiens
atgggctgagtattg

SEQ ID NO: 493524 - DNA, 15 bp, Homo sapiens
tgggctgagtattgg

SEQ ID NO: 493525 - DNA, 15 bp, Homo sapiens
gggctgagtattggc

SEQ ID NO: 493526 - DNA, 15 bp, Homo sapiens
ggctgagtattggca

SEQ ID NO: 493527 - DNA, 15 bp, Homo sapiens
gctgagtattggcat

SEQ ID NO: 493528 - DNA, 15 bp, Homo sapiens
ctgagtattggcatt

SEQ ID NO: 493529 - DNA, 15 bp, Homo sapiens
tgagtattggcattt

SEQ ID NO: 493530 - DNA, 15 bp, Homo sapiens
gagtattggcattta

SEQ ID NO: 493531 - DNA, 15 bp, Homo sapiens
agtattggcatttaa

SEQ ID NO: 493532 - DNA, 15 bp, Homo sapiens
gtattggcatttaaa

SEQ ID NO: 493533 - DNA, 15 bp, Homo sapiens
tattggcatttaaaa

SEQ ID NO: 493534 - DNA, 15 bp, Homo sapiens
attggcatttaaaaa

SEQ ID NO: 493535 - DNA, 15 bp, Homo sapiens
ttggcatttaaaaag

SEQ ID NO: 493536 - DNA, 15 bp, Homo sapiens
tggcatttaaaaagt

SEQ ID NO: 493537 - DNA, 15 bp, Homo sapiens
ggcatttaaaaagtt

SEQ ID NO: 493538 - DNA, 15 bp, Homo sapiens
gcatttaaaaagttg

SEQ ID NO: 493539 - DNA, 15 bp, Homo sapiens
catttaaaaagttga

SEQ ID NO: 493540 - DNA, 15 bp, Homo sapiens
atttaaaaagttgaa

SEQ ID NO: 493541 - DNA, 15 bp, Homo sapiens
tttaaaaagttgaag

SEQ ID NO: 493542 - DNA, 15 bp, Homo sapiens
ttaaaaagttgaagt

SEQ ID NO: 493543 - DNA, 15 bp, Homo sapiens
taaaaagttgaagtt

SEQ ID NO: 493544 - DNA, 15 bp, Homo sapiens
aaaaagttgaagttg

SEQ ID NO: 493545 - DNA, 15 bp, Homo sapiens
aaaagttgaagttgg

SEQ ID NO: 493546 - DNA, 15 bp, Homo sapiens
aaagttgaagttggg

SEQ ID NO: 493547 - DNA, 15 bp, Homo sapiens
aagttgaagttgggg

SEQ ID NO: 493548 - DNA, 15 bp, Homo sapiens
agttgaagttggggt

SEQ ID NO: 493549 - DNA, 15 bp, Homo sapiens
gttgaagttggggtt

SEQ ID NO: 493550 - DNA, 15 bp, Homo sapiens
ttgaagttggggttt

SEQ ID NO: 493551 - DNA, 15 bp, Homo sapiens
tgaagttggggtttg

SEQ ID NO: 493552 - DNA, 15 bp, Homo sapiens
gaagttggggtttga

SEQ ID NO: 493553 - DNA, 15 bp, Homo sapiens
aagttggggtttgac

SEQ ID NO: 493554 - DNA, 15 bp, Homo sapiens
agttggggtttgaca

SEQ ID NO: 493555 - DNA, 15 bp, Homo sapiens
gttggggtttgacaa

SEQ ID NO: 493556 - DNA, 15 bp, Homo sapiens
ttggggtttgacaaa

SEQ ID NO: 493557 - DNA, 15 bp, Homo sapiens
tggggtttgacaaag

SEQ ID NO: 493558 - DNA, 15 bp, Homo sapiens
ggggtttgacaaagt

SEQ ID NO: 493559 - DNA, 15 bp, Homo sapiens
gggtttgacaaagtg

SEQ ID NO: 493560 - DNA, 15 bp, Homo sapiens
ggtttgacaaagtga

SEQ ID NO: 493561 - DNA, 15 bp, Homo sapiens
gtttgacaaagtgag

SEQ ID NO: 493562 - DNA, 15 bp, Homo sapiens
tttgacaaagtgagt

SEQ ID NO: 493563 - DNA, 15 bp, Homo sapiens
ttgacaaagtgagta

SEQ ID NO: 493564 - DNA, 15 bp, Homo sapiens
tgacaaagtgagtac

SEQ ID NO: 493565 - DNA, 15 bp, Homo sapiens
gacaaagtgagtaca

SEQ ID NO: 493566 - DNA, 15 bp, Homo sapiens
acaaagtgagtacag

SEQ ID NO: 493567 - DNA, 15 bp, Homo sapiens
caaagtgagtacagt

SEQ ID NO: 493568 - DNA, 15 bp, Homo sapiens
aaagtgagtacagtg

SEQ ID NO: 493569 - DNA, 15 bp, Homo sapiens
aagtgagtacagtga

SEQ ID NO: 493570 - DNA, 15 bp, Homo sapiens
agtgagtacagtgat

SEQ ID NO: 493571 - DNA, 15 bp, Homo sapiens
gtgagtacagtgatt

SEQ ID NO: 493572 - DNA, 15 bp, Homo sapiens
tgagtacagtgattc

SEQ ID NO: 493573 - DNA, 15 bp, Homo sapiens
gagtacagtgattca

SEQ ID NO: 493574 - DNA, 15 bp, Homo sapiens
agtacagtgattcaa

SEQ ID NO: 493575 - DNA, 15 bp, Homo sapiens
gtacagtgattcaag

SEQ ID NO: 493576 - DNA, 15 bp, Homo sapiens
tacagtgattcaagg

SEQ ID NO: 493577 - DNA, 15 bp, Homo sapiens
acagtgattcaaggg

SEQ ID NO: 493578 - DNA, 15 bp, Homo sapiens
cagtgattcaaggga

SEQ ID NO: 493579 - DNA, 15 bp, Homo sapiens
agtgattcaagggaa

SEQ ID NO: 493580 - DNA, 15 bp, Homo sapiens
gtgattcaagggaag

SEQ ID NO: 493581 - DNA, 15 bp, Homo sapiens
tgattcaagggaaga

SEQ ID NO: 493582 - DNA, 15 bp, Homo sapiens
gattcaagggaagag

SEQ ID NO: 493583 - DNA, 15 bp, Homo sapiens
attcaagggaagagg

SEQ ID NO: 493584 - DNA, 15 bp, Homo sapiens
ttcaagggaagaggc

SEQ ID NO: 493585 - DNA, 15 bp, Homo sapiens
tcaagggaagaggca

SEQ ID NO: 493586 - DNA, 15 bp, Homo sapiens
caagggaagaggcaa

SEQ ID NO: 493587 - DNA, 15 bp, Homo sapiens
aagggaagaggcaaa

SEQ ID NO: 493588 - DNA, 15 bp, Homo sapiens
agggaagaggcaaag

SEQ ID NO: 493589 - DNA, 15 bp, Homo sapiens
gggaagaggcaaaga

SEQ ID NO: 493590 - DNA, 15 bp, Homo sapiens
ggaagaggcaaagaa

SEQ ID NO: 493591 - DNA, 15 bp, Homo sapiens
gaagaggcaaagaag

SEQ ID NO: 493592 - DNA, 15 bp, Homo sapiens
aagaggcaaagaagt

SEQ ID NO: 493593 - DNA, 15 bp, Homo sapiens
agaggcaaagaagtg

SEQ ID NO: 493594 - DNA, 15 bp, Homo sapiens
gaggcaaagaagtga

SEQ ID NO: 493595 - DNA, 15 bp, Homo sapiens
aggcaaagaagtgat

SEQ ID NO: 493596 - DNA, 15 bp, Homo sapiens
ggcaaagaagtgatt

SEQ ID NO: 493597 - DNA, 15 bp, Homo sapiens
gcaaagaagtgatta

SEQ ID NO: 493598 - DNA, 15 bp, Homo sapiens
caaagaagtgattat

SEQ ID NO: 493599 - DNA, 15 bp, Homo sapiens
aaagaagtgattata

SEQ ID NO: 493600 - DNA, 15 bp, Homo sapiens
aagaagtgattataa

SEQ ID NO: 493601 - DNA, 15 bp, Homo sapiens
agaagtgattataat

SEQ ID NO: 493602 - DNA, 15 bp, Homo sapiens
gaagtgattataatg

SEQ ID NO: 493603 - DNA, 15 bp, Homo sapiens
aagtgattataatga

SEQ ID NO: 493604 - DNA, 15 bp, Homo sapiens
agtgattataatgat

SEQ ID NO: 493605 - DNA, 15 bp, Homo sapiens
gtgattataatgatt

SEQ ID NO: 493606 - DNA, 15 bp, Homo sapiens
tgattataatgattg

SEQ ID NO: 493607 - DNA, 15 bp, Homo sapiens
gattataatgattga

SEQ ID NO: 493608 - DNA, 15 bp, Homo sapiens
attataatgattgaa

SEQ ID NO: 493609 - DNA, 15 bp, Homo sapiens
ttataatgattgaac

SEQ ID NO: 493610 - DNA, 15 bp, Homo sapiens
tataatgattgaacc

SEQ ID NO: 493611 - DNA, 15 bp, Homo sapiens
ataatgattgaacca

SEQ ID NO: 493612 - DNA, 15 bp, Homo sapiens
taatgattgaaccag

SEQ ID NO: 493613 - DNA, 15 bp, Homo sapiens
aatgattgaaccaga

SEQ ID NO: 493614 - DNA, 15 bp, Homo sapiens
atgattgaaccagat

SEQ ID NO: 493615 - DNA, 15 bp, Homo sapiens
tgattgaaccagatg

SEQ ID NO: 493616 - DNA, 15 bp, Homo sapiens
gattgaaccagatgc

SEQ ID NO: 493617 - DNA, 15 bp, Homo sapiens
attgaaccagatgct

SEQ ID NO: 493618 - DNA, 15 bp, Homo sapiens
ttgaaccagatgctt

SEQ ID NO: 493619 - DNA, 15 bp, Homo sapiens
tgaaccagatgctta

SEQ ID NO: 493620 - DNA, 15 bp, Homo sapiens
gaaccagatgcttaa

SEQ ID NO: 493621 - DNA, 15 bp, Homo sapiens
aaccagatgcttaag

SEQ ID NO: 493622 - DNA, 15 bp, Homo sapiens
accagatgcttaagc

SEQ ID NO: 493623 - DNA, 15 bp, Homo sapiens
ccagatgcttaagct

SEQ ID NO: 493624 - DNA, 15 bp, Homo sapiens
cagatgcttaagctc

SEQ ID NO: 493625 - DNA, 15 bp, Homo sapiens
agatgcttaagctca

SEQ ID NO: 493626 - DNA, 15 bp, Homo sapiens
gatgcttaagctcag

SEQ ID NO: 493627 - DNA, 15 bp, Homo sapiens
atgcttaagctcagt

SEQ ID NO: 493628 - DNA, 15 bp, Homo sapiens
tgcttaagctcagta

SEQ ID NO: 493629 - DNA, 15 bp, Homo sapiens
gcttaagctcagtag

SEQ ID NO: 493630 - DNA, 15 bp, Homo sapiens
cttaagctcagtagt

SEQ ID NO: 493631 - DNA, 15 bp, Homo sapiens
ttaagctcagtagtg

SEQ ID NO: 493632 - DNA, 15 bp, Homo sapiens
taagctcagtagtga

SEQ ID NO: 493633 - DNA, 15 bp, Homo sapiens
aagctcagtagtgaa

SEQ ID NO: 493634 - DNA, 15 bp, Homo sapiens
agctcagtagtgaaa

SEQ ID NO: 493635 - DNA, 15 bp, Homo sapiens
gctcagtagtgaaag

SEQ ID NO: 493636 - DNA, 15 bp, Homo sapiens
ctcagtagtgaaagg

SEQ ID NO: 493637 - DNA, 15 bp, Homo sapiens
tcagtagtgaaagga

SEQ ID NO: 493638 - DNA, 15 bp, Homo sapiens
cagtagtgaaaggaa

SEQ ID NO: 493639 - DNA, 15 bp, Homo sapiens
agtagtgaaaggaat

SEQ ID NO: 493640 - DNA, 15 bp, Homo sapiens
gtagtgaaaggaatg

SEQ ID NO: 493641 - DNA, 15 bp, Homo sapiens
tagtgaaaggaatga

SEQ ID NO: 493642 - DNA, 15 bp, Homo sapiens
agtgaaaggaatgag

SEQ ID NO: 493643 - DNA, 15 bp, Homo sapiens
gtgaaaggaatgagg

SEQ ID NO: 493644 - DNA, 15 bp, Homo sapiens
tgaaaggaatgagga

SEQ ID NO: 493645 - DNA, 15 bp, Homo sapiens
gaaaggaatgaggaa

SEQ ID NO: 493646 - DNA, 15 bp, Homo sapiens
aaaggaatgaggaaa

SEQ ID NO: 493647 - DNA, 15 bp, Homo sapiens
aaggaatgaggaaat

SEQ ID NO: 493648 - DNA, 15 bp, Homo sapiens
aggaatgaggaaatg

SEQ ID NO: 493649 - DNA, 15 bp, Homo sapiens
ggaatgaggaaatgt

SEQ ID NO: 493650 - DNA, 15 bp, Homo sapiens
gaatgaggaaatgtc

SEQ ID NO: 493651 - DNA, 15 bp, Homo sapiens
aatgaggaaatgtcc

SEQ ID NO: 493652 - DNA, 15 bp, Homo sapiens
atgaggaaatgtcca

SEQ ID NO: 493653 - DNA, 15 bp, Homo sapiens
tgaggaaatgtccag

SEQ ID NO: 493654 - DNA, 15 bp, Homo sapiens
gaggaaatgtccagt

SEQ ID NO: 493655 - DNA, 15 bp, Homo sapiens
aggaaatgtccagtg

SEQ ID NO: 493656 - DNA, 15 bp, Homo sapiens
ggaaatgtccagtgt

SEQ ID NO: 493657 - DNA, 15 bp, Homo sapiens
gaaatgtccagtgtg

SEQ ID NO: 493658 - DNA, 15 bp, Homo sapiens
aaatgtccagtgtgg

SEQ ID NO: 493659 - DNA, 15 bp, Homo sapiens
aatgtccagtgtggg

SEQ ID NO: 493660 - DNA, 15 bp, Homo sapiens
atgtccagtgtggga

SEQ ID NO: 493661 - DNA, 15 bp, Homo sapiens
tgtccagtgtgggag

SEQ ID NO: 493662 - DNA, 15 bp, Homo sapiens
gtccagtgtgggaga

SEQ ID NO: 493663 - DNA, 15 bp, Homo sapiens
tccagtgtgggagac

SEQ ID NO: 493664 - DNA, 15 bp, Homo sapiens
ccagtgtgggagaca

SEQ ID NO: 493665 - DNA, 15 bp, Homo sapiens
cagtgtgggagacag

SEQ ID NO: 493666 - DNA, 15 bp, Homo sapiens
agtgtgggagacaga

SEQ ID NO: 493667 - DNA, 15 bp, Homo sapiens
gtgtgggagacagaa

SEQ ID NO: 493668 - DNA, 15 bp, Homo sapiens
tgtgggagacagaaa

SEQ ID NO: 493669 - DNA, 15 bp, Homo sapiens
gtgggagacagaaat

SEQ ID NO: 493670 - DNA, 15 bp, Homo sapiens
tgggagacagaaata

SEQ ID NO: 493671 - DNA, 15 bp, Homo sapiens
gggagacagaaataa

SEQ ID NO: 493672 - DNA, 15 bp, Homo sapiens
ggagacagaaataaa

SEQ ID NO: 493673 - DNA, 15 bp, Homo sapiens
gagacagaaataaag

SEQ ID NO: 493674 - DNA, 15 bp, Homo sapiens
agacagaaataaaga

SEQ ID NO: 493675 - DNA, 15 bp, Homo sapiens
gacagaaataaagat

SEQ ID NO: 493676 - DNA, 15 bp, Homo sapiens
acagaaataaagatg

SEQ ID NO: 493677 - DNA, 15 bp, Homo sapiens
cagaaataaagatgg

SEQ ID NO: 493678 - DNA, 15 bp, Homo sapiens
agaaataaagatggg

SEQ ID NO: 493679 - DNA, 15 bp, Homo sapiens
gaaataaagatggga

SEQ ID NO: 493680 - DNA, 15 bp, Homo sapiens
aaataaagatgggag

SEQ ID NO: 493681 - DNA, 15 bp, Homo sapiens
aataaagatgggagg

SEQ ID NO: 493682 - DNA, 15 bp, Homo sapiens
ataaagatgggagga

SEQ ID NO: 493683 - DNA, 15 bp, Homo sapiens
taaagatgggaggat

SEQ ID NO: 493684 - DNA, 15 bp, Homo sapiens
aaagatgggaggatc

SEQ ID NO: 493685 - DNA, 15 bp, Homo sapiens
aagatgggaggatca

SEQ ID NO: 493686 - DNA, 15 bp, Homo sapiens
agatgggaggatcaa

SEQ ID NO: 493687 - DNA, 15 bp, Homo sapiens
gatgggaggatcaat

SEQ ID NO: 493688 - DNA, 15 bp, Homo sapiens
atgggaggatcaatg

SEQ ID NO: 493689 - DNA, 15 bp, Homo sapiens
tgggaggatcaatgg

SEQ ID NO: 493690 - DNA, 15 bp, Homo sapiens
gggaggatcaatgga

SEQ ID NO: 493691 - DNA, 15 bp, Homo sapiens
ggaggatcaatggat

SEQ ID NO: 493692 - DNA, 15 bp, Homo sapiens
gaggatcaatggatc

SEQ ID NO: 493693 - DNA, 15 bp, Homo sapiens
aggatcaatggatcc

SEQ ID NO: 493694 - DNA, 15 bp, Homo sapiens
ggatcaatggatcct

SEQ ID NO: 493695 - DNA, 15 bp, Homo sapiens
gatcaatggatccta

SEQ ID NO: 493696 - DNA, 15 bp, Homo sapiens
atcaatggatcctat

SEQ ID NO: 493697 - DNA, 15 bp, Homo sapiens
tcaatggatcctatt

SEQ ID NO: 493698 - DNA, 15 bp, Homo sapiens
caatggatcctattg

SEQ ID NO: 493699 - DNA, 15 bp, Homo sapiens
aatggatcctattgt

SEQ ID NO: 493700 - DNA, 15 bp, Homo sapiens
atggatcctattgtc

SEQ ID NO: 493701 - DNA, 15 bp, Homo sapiens
tggatcctattgtca

SEQ ID NO: 493702 - DNA, 15 bp, Homo sapiens
ggatcctattgtcaa

SEQ ID NO: 493703 - DNA, 15 bp, Homo sapiens
gatcctattgtcaaa

SEQ ID NO: 493704 - DNA, 15 bp, Homo sapiens
atcctattgtcaaag

SEQ ID NO: 493705 - DNA, 15 bp, Homo sapiens
tcctattgtcaaagg

SEQ ID NO: 493706 - DNA, 15 bp, Homo sapiens
cctattgtcaaagga

SEQ ID NO: 493707 - DNA, 15 bp, Homo sapiens
ctattgtcaaaggat

SEQ ID NO: 493708 - DNA, 15 bp, Homo sapiens
tattgtcaaaggatg

SEQ ID NO: 493709 - DNA, 15 bp, Homo sapiens
attgtcaaaggatgg

SEQ ID NO: 493710 - DNA, 15 bp, Homo sapiens
ttgtcaaaggatgga

SEQ ID NO: 493711 - DNA, 15 bp, Homo sapiens
tgtcaaaggatggat

SEQ ID NO: 493712 - DNA, 15 bp, Homo sapiens
gtcaaaggatggata

SEQ ID NO: 493713 - DNA, 15 bp, Homo sapiens
tcaaaggatggataa

SEQ ID NO: 493714 - DNA, 15 bp, Homo sapiens
caaaggatggataaa

SEQ ID NO: 493715 - DNA, 15 bp, Homo sapiens
aaaggatggataaat

SEQ ID NO: 493716 - DNA, 15 bp, Homo sapiens
aaggatggataaatt

SEQ ID NO: 493717 - DNA, 15 bp, Homo sapiens
aggatggataaattt

SEQ ID NO: 493718 - DNA, 15 bp, Homo sapiens
ggatggataaatttg

SEQ ID NO: 493719 - DNA, 15 bp, Homo sapiens
gatggataaatttgc

SEQ ID NO: 493720 - DNA, 15 bp, Homo sapiens
atggataaatttgca

SEQ ID NO: 493721 - DNA, 15 bp, Homo sapiens
tggataaatttgcag

SEQ ID NO: 493722 - DNA, 15 bp, Homo sapiens
ggataaatttgcagt

SEQ ID NO: 493723 - DNA, 15 bp, Homo sapiens
gataaatttgcagtt

SEQ ID NO: 493724 - DNA, 15 bp, Homo sapiens
ataaatttgcagttg

SEQ ID NO: 493725 - DNA, 15 bp, Homo sapiens
taaatttgcagttgt

SEQ ID NO: 493726 - DNA, 15 bp, Homo sapiens
aaatttgcagttgta

SEQ ID NO: 493727 - DNA, 15 bp, Homo sapiens
aatttgcagttgtag

SEQ ID NO: 493728 - DNA, 15 bp, Homo sapiens
atttgcagttgtagg

SEQ ID NO: 493729 - DNA, 15 bp, Homo sapiens
tttgcagttgtaggg

SEQ ID NO: 493730 - DNA, 15 bp, Homo sapiens
ttgcagttgtagggg

SEQ ID NO: 493731 - DNA, 15 bp, Homo sapiens
tgcagttgtagggga

SEQ ID NO: 493732 - DNA, 15 bp, Homo sapiens
gcagttgtaggggaa

SEQ ID NO: 493733 - DNA, 15 bp, Homo sapiens
cagttgtaggggaag

SEQ ID NO: 493734 - DNA, 15 bp, Homo sapiens
agttgtaggggaagt

SEQ ID NO: 493735 - DNA, 15 bp, Homo sapiens
gttgtaggggaagta

SEQ ID NO: 493736 - DNA, 15 bp, Homo sapiens
ttgtaggggaagtaa

SEQ ID NO: 493737 - DNA, 15 bp, Homo sapiens
tgtaggggaagtaag

SEQ ID NO: 493738 - DNA, 15 bp, Homo sapiens
gtaggggaagtaagc

SEQ ID NO: 493739 - DNA, 15 bp, Homo sapiens
taggggaagtaagct

SEQ ID NO: 493740 - DNA, 15 bp, Homo sapiens
aggggaagtaagctg

SEQ ID NO: 493741 - DNA, 15 bp, Homo sapiens
ggggaagtaagctgt

SEQ ID NO: 493742 - DNA, 15 bp, Homo sapiens
gggaagtaagctgtg

SEQ ID NO: 493743 - DNA, 15 bp, Homo sapiens
ggaagtaagctgtgg

SEQ ID NO: 493744 - DNA, 15 bp, Homo sapiens
gaagtaagctgtgga

SEQ ID NO: 493745 - DNA, 15 bp, Homo sapiens
aagtaagctgtggag

SEQ ID NO: 493746 - DNA, 15 bp, Homo sapiens
agtaagctgtggagg

SEQ ID NO: 493747 - DNA, 15 bp, Homo sapiens
gtaagctgtggaggt

SEQ ID NO: 493748 - DNA, 15 bp, Homo sapiens
taagctgtggaggta

SEQ ID NO: 493749 - DNA, 15 bp, Homo sapiens
aagctgtggaggtag

SEQ ID NO: 493750 - DNA, 15 bp, Homo sapiens
agctgtggaggtaga

SEQ ID NO: 493751 - DNA, 15 bp, Homo sapiens
gctgtggaggtagag

SEQ ID NO: 493752 - DNA, 15 bp, Homo sapiens
ctgtggaggtagagg

SEQ ID NO: 493753 - DNA, 15 bp, Homo sapiens
tgtggaggtagaggt

SEQ ID NO: 493754 - DNA, 15 bp, Homo sapiens
gtggaggtagaggtg

SEQ ID NO: 493755 - DNA, 15 bp, Homo sapiens
tggaggtagaggtgg

SEQ ID NO: 493756 - DNA, 15 bp, Homo sapiens
ggaggtagaggtggt

SEQ ID NO: 493757 - DNA, 15 bp, Homo sapiens
gaggtagaggtggtt

SEQ ID NO: 493758 - DNA, 15 bp, Homo sapiens
aggtagaggtggttg

SEQ ID NO: 493759 - DNA, 15 bp, Homo sapiens
ggtagaggtggttgt

SEQ ID NO: 493760 - DNA, 15 bp, Homo sapiens
gtagaggtggttgtc

SEQ ID NO: 493761 - DNA, 15 bp, Homo sapiens
tagaggtggttgtca

SEQ ID NO: 493762 - DNA, 15 bp, Homo sapiens
agaggtggttgtcag

SEQ ID NO: 493763 - DNA, 15 bp, Homo sapiens
gaggtggttgtcaga

SEQ ID NO: 493764 - DNA, 15 bp, Homo sapiens
aggtggttgtcagaa

SEQ ID NO: 493765 - DNA, 15 bp, Homo sapiens
ggtggttgtcagaag

SEQ ID NO: 493766 - DNA, 15 bp, Homo sapiens
gtggttgtcagaagc

SEQ ID NO: 493767 - DNA, 15 bp, Homo sapiens
tggttgtcagaagct

SEQ ID NO: 493768 - DNA, 15 bp, Homo sapiens
ggttgtcagaagcta

SEQ ID NO: 493769 - DNA, 15 bp, Homo sapiens
gttgtcagaagctag

SEQ ID NO: 493770 - DNA, 15 bp, Homo sapiens
ttgtcagaagctagg

SEQ ID NO: 493771 - DNA, 15 bp, Homo sapiens
tgtcagaagctaggt

SEQ ID NO: 493772 - DNA, 15 bp, Homo sapiens
gtcagaagctaggtt

SEQ ID NO: 493773 - DNA, 15 bp, Homo sapiens
tcagaagctaggttg

SEQ ID NO: 493774 - DNA, 15 bp, Homo sapiens
agaccaaatgtttga

SEQ ID NO: 493775 - DNA, 15 bp, Homo sapiens
gaccaaatgtttgac

SEQ ID NO: 493776 - DNA, 15 bp, Homo sapiens
accaaatgtttgacc

SEQ ID NO: 493777 - DNA, 15 bp, Homo sapiens
ccaaatgtttgacct

SEQ ID NO: 493778 - DNA, 15 bp, Homo sapiens
caaatgtttgacctt

SEQ ID NO: 493779 - DNA, 15 bp, Homo sapiens
aaatgtttgaccttc

SEQ ID NO: 493780 - DNA, 15 bp, Homo sapiens
aatgtttgaccttcc

SEQ ID NO: 493781 - DNA, 15 bp, Homo sapiens
atgtttgaccttccc

SEQ ID NO: 493782 - DNA, 15 bp, Homo sapiens
tgtttgaccttccct

SEQ ID NO: 493783 - DNA, 15 bp, Homo sapiens
gtttgaccttccctt

SEQ ID NO: 493784 - DNA, 15 bp, Homo sapiens
tttgaccttcccttc

SEQ ID NO: 493785 - DNA, 15 bp, Homo sapiens
ttgaccttcccttca

SEQ ID NO: 493786 - DNA, 15 bp, Homo sapiens
tgaccttcccttcaa

SEQ ID NO: 493787 - DNA, 15 bp, Homo sapiens
gaccttcccttcaaa

SEQ ID NO: 493788 - DNA, 15 bp, Homo sapiens
accttcccttcaaaa

SEQ ID NO: 493789 - DNA, 15 bp, Homo sapiens
ccttcccttcaaaag

SEQ ID NO: 493790 - DNA, 15 bp, Homo sapiens
cttcccttcaaaagg

SEQ ID NO: 493791 - DNA, 15 bp, Homo sapiens
ttcccttcaaaaggt

SEQ ID NO: 493792 - DNA, 15 bp, Homo sapiens
tcccttcaaaaggtt

SEQ ID NO: 493793 - DNA, 15 bp, Homo sapiens
cccttcaaaaggttg

SEQ ID NO: 493794 - DNA, 15 bp, Homo sapiens
ccttcaaaaggttga

SEQ ID NO: 493795 - DNA, 15 bp, Homo sapiens
cttcaaaaggttgat

SEQ ID NO: 493796 - DNA, 15 bp, Homo sapiens
ttcaaaaggttgata

SEQ ID NO: 493797 - DNA, 15 bp, Homo sapiens
tcaaaaggttgatac

SEQ ID NO: 493798 - DNA, 15 bp, Homo sapiens
caaaaggttgatacc

SEQ ID NO: 493799 - DNA, 15 bp, Homo sapiens
aaaaggttgatacca

SEQ ID NO: 493800 - DNA, 15 bp, Homo sapiens
aaaggttgataccac

SEQ ID NO: 493801 - DNA, 15 bp, Homo sapiens
aaggttgataccact

SEQ ID NO: 493802 - DNA, 15 bp, Homo sapiens
aggttgataccactt

SEQ ID NO: 493803 - DNA, 15 bp, Homo sapiens
ggttgataccacttc

SEQ ID NO: 493804 - DNA, 15 bp, Homo sapiens
gttgataccacttcc

SEQ ID NO: 493805 - DNA, 15 bp, Homo sapiens
ttgataccacttcca

SEQ ID NO: 493806 - DNA, 15 bp, Homo sapiens
tgataccacttccat

SEQ ID NO: 493807 - DNA, 15 bp, Homo sapiens
gataccacttccatg

SEQ ID NO: 493808 - DNA, 15 bp, Homo sapiens
ataccacttccatga

SEQ ID NO: 493809 - DNA, 15 bp, Homo sapiens
taccacttccatgag

SEQ ID NO: 493810 - DNA, 15 bp, Homo sapiens
accacttccatgagt

SEQ ID NO: 493811 - DNA, 15 bp, Homo sapiens
ccacttccatgagtg

SEQ ID NO: 493812 - DNA, 15 bp, Homo sapiens
cacttccatgagtgt

SEQ ID NO: 493813 - DNA, 15 bp, Homo sapiens
acttccatgagtgtg

SEQ ID NO: 493814 - DNA, 15 bp, Homo sapiens
cttccatgagtgtgg

SEQ ID NO: 493815 - DNA, 15 bp, Homo sapiens
ttccatgagtgtggc

SEQ ID NO: 493816 - DNA, 15 bp, Homo sapiens
tccatgagtgtggcc

SEQ ID NO: 493817 - DNA, 15 bp, Homo sapiens
ccatgagtgtggcct

SEQ ID NO: 493818 - DNA, 15 bp, Homo sapiens
catgagtgtggcctg

SEQ ID NO: 493819 - DNA, 15 bp, Homo sapiens
atgagtgtggcctgg

SEQ ID NO: 493820 - DNA, 15 bp, Homo sapiens
tgagtgtggcctgga

SEQ ID NO: 493821 - DNA, 15 bp, Homo sapiens
gagtgtggcctggat

SEQ ID NO: 493822 - DNA, 15 bp, Homo sapiens
agtgtggcctggatt

SEQ ID NO: 493823 - DNA, 15 bp, Homo sapiens
gtgtggcctggattt

SEQ ID NO: 493824 - DNA, 15 bp, Homo sapiens
tgtggcctggattta

SEQ ID NO: 493825 - DNA, 15 bp, Homo sapiens
gtggcctggatttat

SEQ ID NO: 493826 - DNA, 15 bp, Homo sapiens
tggcctggatttata

SEQ ID NO: 493827 - DNA, 15 bp, Homo sapiens
ggcctggatttatat

SEQ ID NO: 493828 - DNA, 15 bp, Homo sapiens
gcctggatttatatt

SEQ ID NO: 493829 - DNA, 15 bp, Homo sapiens
cctggatttatattg

SEQ ID NO: 493830 - DNA, 15 bp, Homo sapiens
ctggatttatattgt

SEQ ID NO: 493831 - DNA, 15 bp, Homo sapiens
tggatttatattgtc

SEQ ID NO: 493832 - DNA, 15 bp, Homo sapiens
ggatttatattgtct

SEQ ID NO: 493833 - DNA, 15 bp, Homo sapiens
gatttatattgtctc

SEQ ID NO: 493834 - DNA, 15 bp, Homo sapiens
atttatattgtctct

SEQ ID NO: 493835 - DNA, 15 bp, Homo sapiens
tttatattgtctctg

SEQ ID NO: 493836 - DNA, 15 bp, Homo sapiens
ttatattgtctctga

SEQ ID NO: 493837 - DNA, 15 bp, Homo sapiens
tatattgtctctgac

SEQ ID NO: 493838 - DNA, 15 bp, Homo sapiens
atattgtctctgacc

SEQ ID NO: 493839 - DNA, 15 bp, Homo sapiens
tattgtctctgacct

SEQ ID NO: 493840 - DNA, 15 bp, Homo sapiens
attgtctctgacctg

SEQ ID NO: 493841 - DNA, 15 bp, Homo sapiens
ttgtctctgacctgg

SEQ ID NO: 493842 - DNA, 15 bp, Homo sapiens
tgtctctgacctggg

SEQ ID NO: 493843 - DNA, 15 bp, Homo sapiens
gtctctgacctggga

SEQ ID NO: 493844 - DNA, 15 bp, Homo sapiens
tctctgacctgggac

SEQ ID NO: 493845 - DNA, 15 bp, Homo sapiens
ctctgacctgggaca

SEQ ID NO: 493846 - DNA, 15 bp, Homo sapiens
tctgacctgggacat

SEQ ID NO: 493847 - DNA, 15 bp, Homo sapiens
ctgacctgggacatt

SEQ ID NO: 493848 - DNA, 15 bp, Homo sapiens
tgacctgggacattt

SEQ ID NO: 493849 - DNA, 15 bp, Homo sapiens
gacctgggacattta

SEQ ID NO: 493850 - DNA, 15 bp, Homo sapiens
acctgggacatttaa

SEQ ID NO: 493851 - DNA, 15 bp, Homo sapiens
cctgggacatttaac

SEQ ID NO: 493852 - DNA, 15 bp, Homo sapiens
ctgggacatttaact

SEQ ID NO: 493853 - DNA, 15 bp, Homo sapiens
tgggacatttaactt

SEQ ID NO: 493854 - DNA, 15 bp, Homo sapiens
gggacatttaacttt

SEQ ID NO: 493855 - DNA, 15 bp, Homo sapiens
ggacatttaacttta

SEQ ID NO: 493856 - DNA, 15 bp, Homo sapiens
gacatttaactttaa

SEQ ID NO: 493857 - DNA, 15 bp, Homo sapiens
acatttaactttaac

SEQ ID NO: 493858 - DNA, 15 bp, Homo sapiens
catttaactttaact

SEQ ID NO: 493859 - DNA, 15 bp, Homo sapiens
atttaactttaactg

SEQ ID NO: 493860 - DNA, 15 bp, Homo sapiens
tttaactttaactgg

SEQ ID NO: 493861 - DNA, 15 bp, Homo sapiens
ttaactttaactggc

SEQ ID NO: 493862 - DNA, 15 bp, Homo sapiens
taactttaactggca

SEQ ID NO: 493863 - DNA, 15 bp, Homo sapiens
aactttaactggcac

SEQ ID NO: 493864 - DNA, 15 bp, Homo sapiens
actttaactggcacc

SEQ ID NO: 493865 - DNA, 15 bp, Homo sapiens
ctttaactggcacca

SEQ ID NO: 493866 - DNA, 15 bp, Homo sapiens
tttaactggcaccac

SEQ ID NO: 493867 - DNA, 15 bp, Homo sapiens
ttaactggcaccact

SEQ ID NO: 493868 - DNA, 15 bp, Homo sapiens
taactggcaccacta

SEQ ID NO: 493869 - DNA, 15 bp, Homo sapiens
aactggcaccactaa

SEQ ID NO: 493870 - DNA, 15 bp, Homo sapiens
actggcaccactaaa

SEQ ID NO: 493871 - DNA, 15 bp, Homo sapiens
ctggcaccactaaac

SEQ ID NO: 493872 - DNA, 15 bp, Homo sapiens
tggcaccactaaaca

SEQ ID NO: 493873 - DNA, 15 bp, Homo sapiens
ggcaccactaaacac

SEQ ID NO: 493874 - DNA, 15 bp, Homo sapiens
gcaccactaaacacc

SEQ ID NO: 493875 - DNA, 15 bp, Homo sapiens
caccactaaacaccc

SEQ ID NO: 493876 - DNA, 15 bp, Homo sapiens
accactaaacaccct

SEQ ID NO: 493877 - DNA, 15 bp, Homo sapiens
ccactaaacaccctt

SEQ ID NO: 493878 - DNA, 15 bp, Homo sapiens
cactaaacacccttg

SEQ ID NO: 493879 - DNA, 15 bp, Homo sapiens
actaaacacccttgg

SEQ ID NO: 493880 - DNA, 15 bp, Homo sapiens
ctaaacacccttggg

SEQ ID NO: 493881 - DNA, 15 bp, Homo sapiens
taaacacccttgggt

SEQ ID NO: 493882 - DNA, 15 bp, Homo sapiens
aaacacccttgggtt

SEQ ID NO: 493883 - DNA, 15 bp, Homo sapiens
aacacccttgggtta

SEQ ID NO: 493884 - DNA, 15 bp, Homo sapiens
acacccttgggttat

SEQ ID NO: 493885 - DNA, 15 bp, Homo sapiens
cacccttgggttatg

SEQ ID NO: 493886 - DNA, 15 bp, Homo sapiens
acccttgggttatga

SEQ ID NO: 493887 - DNA, 15 bp, Homo sapiens
cccttgggttatgat

SEQ ID NO: 493888 - DNA, 15 bp, Homo sapiens
ccttgggttatgatt

SEQ ID NO: 493889 - DNA, 15 bp, Homo sapiens
cttgggttatgattc

SEQ ID NO: 493890 - DNA, 15 bp, Homo sapiens
ttgggttatgattcc

SEQ ID NO: 493891 - DNA, 15 bp, Homo sapiens
tgggttatgattcct

SEQ ID NO: 493892 - DNA, 15 bp, Homo sapiens
gggttatgattcctg

SEQ ID NO: 493893 - DNA, 15 bp, Homo sapiens
ggttatgattcctgc

SEQ ID NO: 493894 - DNA, 15 bp, Homo sapiens
gttatgattcctgcc

SEQ ID NO: 493895 - DNA, 15 bp, Homo sapiens
ttatgattcctgcct

SEQ ID NO: 493896 - DNA, 15 bp, Homo sapiens
tatgattcctgcctt

SEQ ID NO: 493897 - DNA, 15 bp, Homo sapiens
atgattcctgccttg

SEQ ID NO: 493898 - DNA, 15 bp, Homo sapiens
tgattcctgccttgc

SEQ ID NO: 493899 - DNA, 15 bp, Homo sapiens
gattcctgccttgcc

SEQ ID NO: 493900 - DNA, 15 bp, Homo sapiens
attcctgccttgcct

SEQ ID NO: 493901 - DNA, 15 bp, Homo sapiens
ttcctgccttgcctt

SEQ ID NO: 493902 - DNA, 15 bp, Homo sapiens
tcctgccttgccttc

SEQ ID NO: 493903 - DNA, 15 bp, Homo sapiens
cctgccttgccttcc

SEQ ID NO: 493904 - DNA, 15 bp, Homo sapiens
ctgccttgccttcct

SEQ ID NO: 493905 - DNA, 15 bp, Homo sapiens
tgccttgccttcctc

SEQ ID NO: 493906 - DNA, 15 bp, Homo sapiens
gccttgccttcctct

SEQ ID NO: 493907 - DNA, 15 bp, Homo sapiens
ccttgccttcctctt

SEQ ID NO: 493908 - DNA, 15 bp, Homo sapiens
cttgccttcctcttc

SEQ ID NO: 493909 - DNA, 15 bp, Homo sapiens
ttgccttcctcttct

SEQ ID NO: 493910 - DNA, 15 bp, Homo sapiens
tgccttcctcttctc

SEQ ID NO: 493911 - DNA, 15 bp, Homo sapiens
gccttcctcttctct

SEQ ID NO: 493912 - DNA, 15 bp, Homo sapiens
ccttcctcttctctg

SEQ ID NO: 493913 - DNA, 15 bp, Homo sapiens
cttcctcttctctgg

SEQ ID NO: 493914 - DNA, 15 bp, Homo sapiens
ttcctcttctctgga

SEQ ID NO: 493915 - DNA, 15 bp, Homo sapiens
tcctcttctctggac

SEQ ID NO: 493916 - DNA, 15 bp, Homo sapiens
cctcttctctggact

SEQ ID NO: 493917 - DNA, 15 bp, Homo sapiens
ctcttctctggactc

SEQ ID NO: 493918 - DNA, 15 bp, Homo sapiens
tcttctctggactcc

SEQ ID NO: 493919 - DNA, 15 bp, Homo sapiens
cttctctggactcca

SEQ ID NO: 493920 - DNA, 15 bp, Homo sapiens
tctctggactccagc

SEQ ID NO: 493921 - DNA, 15 bp, Homo sapiens
ctctggactccagct

SEQ ID NO: 493922 - DNA, 15 bp, Homo sapiens
tctggactccagctt

SEQ ID NO: 493923 - DNA, 15 bp, Homo sapiens
ctggactccagcttg

SEQ ID NO: 493924 - DNA, 15 bp, Homo sapiens
tggactccagcttgg

SEQ ID NO: 493925 - DNA, 15 bp, Homo sapiens
ggactccagcttggg

SEQ ID NO: 493926 - DNA, 15 bp, Homo sapiens
gactccagcttggga

SEQ ID NO: 493927 - DNA, 15 bp, Homo sapiens
actccagcttgggat

SEQ ID NO: 493928 - DNA, 15 bp, Homo sapiens
ctccagcttgggatc

SEQ ID NO: 493929 - DNA, 15 bp, Homo sapiens
tccagcttgggatca

SEQ ID NO: 493930 - DNA, 15 bp, Homo sapiens
ccagcttgggatcaa

SEQ ID NO: 493931 - DNA, 15 bp, Homo sapiens
cagcttgggatcaag

SEQ ID NO: 493932 - DNA, 15 bp, Homo sapiens
agcttgggatcaaga

SEQ ID NO: 493933 - DNA, 15 bp, Homo sapiens
gcttgggatcaagat

SEQ ID NO: 493934 - DNA, 15 bp, Homo sapiens
cttgggatcaagatg

SEQ ID NO: 493935 - DNA, 15 bp, Homo sapiens
ttgggatcaagatgg

SEQ ID NO: 493936 - DNA, 15 bp, Homo sapiens
tgggatcaagatggt

SEQ ID NO: 493937 - DNA, 15 bp, Homo sapiens
gggatcaagatggtt

SEQ ID NO: 493938 - DNA, 15 bp, Homo sapiens
ggatcaagatggttg

SEQ ID NO: 493939 - DNA, 15 bp, Homo sapiens
gatcaagatggttgg

SEQ ID NO: 493940 - DNA, 15 bp, Homo sapiens
atcaagatggttggc

SEQ ID NO: 493941 - DNA, 15 bp, Homo sapiens
tcaagatggttggca

SEQ ID NO: 493942 - DNA, 15 bp, Homo sapiens
caagatggttggcat

SEQ ID NO: 493943 - DNA, 15 bp, Homo sapiens
aagatggttggcatt

SEQ ID NO: 493944 - DNA, 15 bp, Homo sapiens
agatggttggcattg

SEQ ID NO: 493945 - DNA, 15 bp, Homo sapiens
gatggttggcattgt

SEQ ID NO: 493946 - DNA, 15 bp, Homo sapiens
atggttggcattgtt

SEQ ID NO: 493947 - DNA, 15 bp, Homo sapiens
tggttggcattgtta

SEQ ID NO: 493948 - DNA, 15 bp, Homo sapiens
ggttggcattgttag

SEQ ID NO: 493949 - DNA, 15 bp, Homo sapiens
gttggcattgttagg

SEQ ID NO: 493950 - DNA, 15 bp, Homo sapiens
ttggcattgttaggg

SEQ ID NO: 493951 - DNA, 15 bp, Homo sapiens
tggcattgttagggt

SEQ ID NO: 493952 - DNA, 15 bp, Homo sapiens
ggcattgttagggta

SEQ ID NO: 493953 - DNA, 15 bp, Homo sapiens
gcattgttagggtac

SEQ ID NO: 493954 - DNA, 15 bp, Homo sapiens
cattgttagggtacc

SEQ ID NO: 493955 - DNA, 15 bp, Homo sapiens
attgttagggtaccc

SEQ ID NO: 493956 - DNA, 15 bp, Homo sapiens
ttgttagggtacccc

SEQ ID NO: 493957 - DNA, 15 bp, Homo sapiens
tgttagggtaccccc

SEQ ID NO: 493958 - DNA, 15 bp, Homo sapiens
gttagggtaccccct

SEQ ID NO: 493959 - DNA, 15 bp, Homo sapiens
ttagggtaccccctc

SEQ ID NO: 493960 - DNA, 15 bp, Homo sapiens
tagggtaccccctct

SEQ ID NO: 493961 - DNA, 15 bp, Homo sapiens
agggtaccccctcta

SEQ ID NO: 493962 - DNA, 15 bp, Homo sapiens
gggtaccccctctac

SEQ ID NO: 493963 - DNA, 15 bp, Homo sapiens
ggtaccccctctaca

SEQ ID NO: 493964 - DNA, 15 bp, Homo sapiens
gtaccccctctacag

SEQ ID NO: 493965 - DNA, 15 bp, Homo sapiens
taccccctctacaga

SEQ ID NO: 493966 - DNA, 15 bp, Homo sapiens
accccctctacagat

SEQ ID NO: 493967 - DNA, 15 bp, Homo sapiens
ccccctctacagatg

SEQ ID NO: 493968 - DNA, 15 bp, Homo sapiens
cccctctacagatga

SEQ ID NO: 493969 - DNA, 15 bp, Homo sapiens
ccctctacagatgac

SEQ ID NO: 493970 - DNA, 15 bp, Homo sapiens
cctctacagatgacc

SEQ ID NO: 493971 - DNA, 15 bp, Homo sapiens
ctctacagatgacct

SEQ ID NO: 493972 - DNA, 15 bp, Homo sapiens
tctacagatgacctc

SEQ ID NO: 493973 - DNA, 15 bp, Homo sapiens
ctacagatgacctcc

SEQ ID NO: 493974 - DNA, 15 bp, Homo sapiens
tacagatgacctccc

SEQ ID NO: 493975 - DNA, 15 bp, Homo sapiens
acagatgacctccca

SEQ ID NO: 493976 - DNA, 15 bp, Homo sapiens
cagatgacctcccac

SEQ ID NO: 493977 - DNA, 15 bp, Homo sapiens
agatgacctcccaca

SEQ ID NO: 493978 - DNA, 15 bp, Homo sapiens
gatgacctcccacag

SEQ ID NO: 493979 - DNA, 15 bp, Homo sapiens
atgacctcccacagt

SEQ ID NO: 493980 - DNA, 15 bp, Homo sapiens
tgacctcccacagtc

SEQ ID NO: 493981 - DNA, 15 bp, Homo sapiens
gacctcccacagtcc

SEQ ID NO: 493982 - DNA, 15 bp, Homo sapiens
acctcccacagtccc

SEQ ID NO: 493983 - DNA, 15 bp, Homo sapiens
cctcccacagtcccc

SEQ ID NO: 493984 - DNA, 15 bp, Homo sapiens
ctcccacagtccccc

SEQ ID NO: 493985 - DNA, 15 bp, Homo sapiens
tcccacagtccccca

SEQ ID NO: 493986 - DNA, 15 bp, Homo sapiens
cccacagtcccccag

SEQ ID NO: 493987 - DNA, 15 bp, Homo sapiens
ccacagtcccccagg

SEQ ID NO: 493988 - DNA, 15 bp, Homo sapiens
cacagtcccccagga

SEQ ID NO: 493989 - DNA, 15 bp, Homo sapiens
acagtcccccaggaa

SEQ ID NO: 493990 - DNA, 15 bp, Homo sapiens
cagtcccccaggaag

SEQ ID NO: 493991 - DNA, 15 bp, Homo sapiens
agtcccccaggaaga

SEQ ID NO: 493992 - DNA, 15 bp, Homo sapiens
gtcccccaggaagac

SEQ ID NO: 493993 - DNA, 15 bp, Homo sapiens
tcccccaggaagaca

SEQ ID NO: 493994 - DNA, 15 bp, Homo sapiens
cccccaggaagacat

SEQ ID NO: 493995 - DNA, 15 bp, Homo sapiens
ccccaggaagacatg

SEQ ID NO: 493996 - DNA, 15 bp, Homo sapiens
cccaggaagacatgg

SEQ ID NO: 493997 - DNA, 15 bp, Homo sapiens
ccaggaagacatggg

SEQ ID NO: 493998 - DNA, 15 bp, Homo sapiens
caggaagacatggga

SEQ ID NO: 493999 - DNA, 15 bp, Homo sapiens
aggaagacatgggat

SEQ ID NO: 494000 - DNA, 15 bp, Homo sapiens
ggaagacatgggata

SEQ ID NO: 494001 - DNA, 15 bp, Homo sapiens
gaagacatgggatat

SEQ ID NO: 494002 - DNA, 15 bp, Homo sapiens
aagacatgggatatt

SEQ ID NO: 494003 - DNA, 15 bp, Homo sapiens
agacatgggatattt

SEQ ID NO: 494004 - DNA, 15 bp, Homo sapiens
gacatgggatatttt

SEQ ID NO: 494005 - DNA, 15 bp, Homo sapiens
acatgggatattttc

SEQ ID NO: 494006 - DNA, 15 bp, Homo sapiens
catgggatattttca

SEQ ID NO: 494007 - DNA, 15 bp, Homo sapiens
atgggatattttcac

SEQ ID NO: 494008 - DNA, 15 bp, Homo sapiens
tgggatattttcacc

SEQ ID NO: 494009 - DNA, 15 bp, Homo sapiens
gggatattttcacca

SEQ ID NO: 494010 - DNA, 15 bp, Homo sapiens
ggatattttcaccag

SEQ ID NO: 494011 - DNA, 15 bp, Homo sapiens
gatattttcaccagc

SEQ ID NO: 494012 - DNA, 15 bp, Homo sapiens
atattttcaccagcc

SEQ ID NO: 494013 - DNA, 15 bp, Homo sapiens
tattttcaccagcct

SEQ ID NO: 494014 - DNA, 15 bp, Homo sapiens
attttcaccagcctc

SEQ ID NO: 494015 - DNA, 15 bp, Homo sapiens
ttttcaccagcctca

SEQ ID NO: 494016 - DNA, 15 bp, Homo sapiens
tttcaccagcctcat

SEQ ID NO: 494017 - DNA, 15 bp, Homo sapiens
ttcaccagcctcatt

SEQ ID NO: 494018 - DNA, 15 bp, Homo sapiens
tcaccagcctcattc

SEQ ID NO: 494019 - DNA, 15 bp, Homo sapiens
caccagcctcattcg

SEQ ID NO: 494020 - DNA, 15 bp, Homo sapiens
accagcctcattcgc

SEQ ID NO: 494021 - DNA, 15 bp, Homo sapiens
ccagcctcattcgct

SEQ ID NO: 494022 - DNA, 15 bp, Homo sapiens
cagcctcattcgctc

SEQ ID NO: 494023 - DNA, 15 bp, Homo sapiens
agcctcattcgctca

SEQ ID NO: 494024 - DNA, 15 bp, Homo sapiens
gcctcattcgctcac

SEQ ID NO: 494025 - DNA, 15 bp, Homo sapiens
cctcattcgctcacc

SEQ ID NO: 494026 - DNA, 15 bp, Homo sapiens
ctcattcgctcacca

SEQ ID NO: 494027 - DNA, 15 bp, Homo sapiens
tcattcgctcaccat

SEQ ID NO: 494028 - DNA, 15 bp, Homo sapiens
cattcgctcaccatt

SEQ ID NO: 494029 - DNA, 15 bp, Homo sapiens
attcgctcaccattg

SEQ ID NO: 494030 - DNA, 15 bp, Homo sapiens
ttcgctcaccattgg

SEQ ID NO: 494031 - DNA, 15 bp, Homo sapiens
tcgctcaccattggt

SEQ ID NO: 494032 - DNA, 15 bp, Homo sapiens
cgctcaccattggta

SEQ ID NO: 494033 - DNA, 15 bp, Homo sapiens
gctcaccattggtac

SEQ ID NO: 494034 - DNA, 15 bp, Homo sapiens
ctcaccattggtacc

SEQ ID NO: 494035 - DNA, 15 bp, Homo sapiens
tcaccattggtacct

SEQ ID NO: 494036 - DNA, 15 bp, Homo sapiens
caccattggtacctt

SEQ ID NO: 494037 - DNA, 15 bp, Homo sapiens
accattggtaccttc

SEQ ID NO: 494038 - DNA, 15 bp, Homo sapiens
ccattggtaccttca

SEQ ID NO: 494039 - DNA, 15 bp, Homo sapiens
cattggtaccttcag

SEQ ID NO: 494040 - DNA, 15 bp, Homo sapiens
attggtaccttcagc

SEQ ID NO: 494041 - DNA, 15 bp, Homo sapiens
ttggtaccttcagca

SEQ ID NO: 494042 - DNA, 15 bp, Homo sapiens
tggtaccttcagcag

SEQ ID NO: 494043 - DNA, 15 bp, Homo sapiens
ggtaccttcagcaga

SEQ ID NO: 494044 - DNA, 15 bp, Homo sapiens
gtaccttcagcagaa

SEQ ID NO: 494045 - DNA, 15 bp, Homo sapiens
taccttcagcagaaa

SEQ ID NO: 494046 - DNA, 15 bp, Homo sapiens
accttcagcagaaag

SEQ ID NO: 494047 - DNA, 15 bp, Homo sapiens
ccttcagcagaaaga

SEQ ID NO: 494048 - DNA, 15 bp, Homo sapiens
cttcagcagaaagaa

SEQ ID NO: 494049 - DNA, 15 bp, Homo sapiens
ttcagcagaaagaaa

SEQ ID NO: 494050 - DNA, 15 bp, Homo sapiens
tcagcagaaagaaat

SEQ ID NO: 494051 - DNA, 15 bp, Homo sapiens
cagcagaaagaaatg

SEQ ID NO: 494052 - DNA, 15 bp, Homo sapiens
agcagaaagaaatga

SEQ ID NO: 494053 - DNA, 15 bp, Homo sapiens
gcagaaagaaatgaa

SEQ ID NO: 494054 - DNA, 15 bp, Homo sapiens
cagaaagaaatgaag

SEQ ID NO: 494055 - DNA, 15 bp, Homo sapiens
agaaagaaatgaagt

SEQ ID NO: 494056 - DNA, 15 bp, Homo sapiens
gaaagaaatgaagtc

SEQ ID NO: 494057 - DNA, 15 bp, Homo sapiens
aaagaaatgaagtcc

SEQ ID NO: 494058 - DNA, 15 bp, Homo sapiens
aagaaatgaagtcct

SEQ ID NO: 494059 - DNA, 15 bp, Homo sapiens
agaaatgaagtcctc

SEQ ID NO: 494060 - DNA, 15 bp, Homo sapiens
gaaatgaagtcctct

SEQ ID NO: 494061 - DNA, 15 bp, Homo sapiens
aaatgaagtcctctc

SEQ ID NO: 494062 - DNA, 15 bp, Homo sapiens
aatgaagtcctctcc

SEQ ID NO: 494063 - DNA, 15 bp, Homo sapiens
atgaagtcctctcca

SEQ ID NO: 494064 - DNA, 15 bp, Homo sapiens
tgaagtcctctccat

SEQ ID NO: 494065 - DNA, 15 bp, Homo sapiens
gaagtcctctccatt

SEQ ID NO: 494066 - DNA, 15 bp, Homo sapiens
aagtcctctccattt

SEQ ID NO: 494067 - DNA, 15 bp, Homo sapiens
agtcctctccatttt

SEQ ID NO: 494068 - DNA, 15 bp, Homo sapiens
gtcctctccatttta

SEQ ID NO: 494069 - DNA, 15 bp, Homo sapiens
tcctctccattttaa

SEQ ID NO: 494070 - DNA, 15 bp, Homo sapiens
cctctccattttaac

SEQ ID NO: 494071 - DNA, 15 bp, Homo sapiens
ctctccattttaact

SEQ ID NO: 494072 - DNA, 15 bp, Homo sapiens
tctccattttaactt

SEQ ID NO: 494073 - DNA, 15 bp, Homo sapiens
ctccattttaacttt

SEQ ID NO: 494074 - DNA, 15 bp, Homo sapiens
tccattttaactttg

SEQ ID NO: 494075 - DNA, 15 bp, Homo sapiens
ccattttaactttgc

SEQ ID NO: 494076 - DNA, 15 bp, Homo sapiens
cattttaactttgct

SEQ ID NO: 494077 - DNA, 15 bp, Homo sapiens
attttaactttgctt

SEQ ID NO: 494078 - DNA, 15 bp, Homo sapiens
ttttaactttgcttc

SEQ ID NO: 494079 - DNA, 15 bp, Homo sapiens
tttaactttgcttcc

SEQ ID NO: 494080 - DNA, 15 bp, Homo sapiens
ttaactttgcttcca

SEQ ID NO: 494081 - DNA, 15 bp, Homo sapiens
taactttgcttccag

SEQ ID NO: 494082 - DNA, 15 bp, Homo sapiens
aactttgcttccagc

SEQ ID NO: 494083 - DNA, 15 bp, Homo sapiens
actttgcttccagcc

SEQ ID NO: 494084 - DNA, 15 bp, Homo sapiens
ctttgcttccagcct

SEQ ID NO: 494085 - DNA, 15 bp, Homo sapiens
tttgcttccagcctg

SEQ ID NO: 494086 - DNA, 15 bp, Homo sapiens
ttgcttccagcctgg

SEQ ID NO: 494087 - DNA, 15 bp, Homo sapiens
tgcttccagcctggc

SEQ ID NO: 494088 - DNA, 15 bp, Homo sapiens
gcttccagcctggcc

SEQ ID NO: 494089 - DNA, 15 bp, Homo sapiens
cttccagcctggcca

SEQ ID NO: 494090 - DNA, 15 bp, Homo sapiens
ttccagcctggccaa

SEQ ID NO: 494091 - DNA, 15 bp, Homo sapiens
tccagcctggccaag

SEQ ID NO: 494092 - DNA, 15 bp, Homo sapiens
cagcctggccaagag

SEQ ID NO: 494093 - DNA, 15 bp, Homo sapiens
agcctggccaagaga

SEQ ID NO: 494094 - DNA, 15 bp, Homo sapiens
gcctggccaagagaa

SEQ ID NO: 494095 - DNA, 15 bp, Homo sapiens
cctggccaagagaaa

SEQ ID NO: 494096 - DNA, 15 bp, Homo sapiens
ctggccaagagaaaa

SEQ ID NO: 494097 - DNA, 15 bp, Homo sapiens
tggccaagagaaaag

SEQ ID NO: 494098 - DNA, 15 bp, Homo sapiens
ggccaagagaaaaga

SEQ ID NO: 494099 - DNA, 15 bp, Homo sapiens
gccaagagaaaagac

SEQ ID NO: 494100 - DNA, 15 bp, Homo sapiens
ccaagagaaaagact

SEQ ID NO: 494101 - DNA, 15 bp, Homo sapiens
caagagaaaagactt

SEQ ID NO: 494102 - DNA, 15 bp, Homo sapiens
aagagaaaagacttt

SEQ ID NO: 494103 - DNA, 15 bp, Homo sapiens
agagaaaagactttc

SEQ ID NO: 494104 - DNA, 15 bp, Homo sapiens
gagaaaagactttca

SEQ ID NO: 494105 - DNA, 15 bp, Homo sapiens
agaaaagactttcag

SEQ ID NO: 494106 - DNA, 15 bp, Homo sapiens
gaaaagactttcaga

SEQ ID NO: 494107 - DNA, 15 bp, Homo sapiens
aaaagactttcagac

SEQ ID NO: 494108 - DNA, 15 bp, Homo sapiens
aaagactttcagact

SEQ ID NO: 494109 - DNA, 15 bp, Homo sapiens
aagactttcagactt

SEQ ID NO: 494110 - DNA, 15 bp, Homo sapiens
agactttcagacttc

SEQ ID NO: 494111 - DNA, 15 bp, Homo sapiens
gactttcagacttcc

SEQ ID NO: 494112 - DNA, 15 bp, Homo sapiens
actttcagacttccc

SEQ ID NO: 494113 - DNA, 15 bp, Homo sapiens
ctttcagacttccct

SEQ ID NO: 494114 - DNA, 15 bp, Homo sapiens
tttcagacttccctc

SEQ ID NO: 494115 - DNA, 15 bp, Homo sapiens
ttcagacttccctct

SEQ ID NO: 494116 - DNA, 15 bp, Homo sapiens
tcagacttccctcta

SEQ ID NO: 494117 - DNA, 15 bp, Homo sapiens
cagacttccctctaa

SEQ ID NO: 494118 - DNA, 15 bp, Homo sapiens
agacttccctctaaa

SEQ ID NO: 494119 - DNA, 15 bp, Homo sapiens
gacttccctctaaat

SEQ ID NO: 494120 - DNA, 15 bp, Homo sapiens
acttccctctaaatc

SEQ ID NO: 494121 - DNA, 15 bp, Homo sapiens
cttccctctaaatca

SEQ ID NO: 494122 - DNA, 15 bp, Homo sapiens
ttccctctaaatcag

SEQ ID NO: 494123 - DNA, 15 bp, Homo sapiens
tccctctaaatcagc

SEQ ID NO: 494124 - DNA, 15 bp, Homo sapiens
ccctctaaatcagct

SEQ ID NO: 494125 - DNA, 15 bp, Homo sapiens
cctctaaatcagctg

SEQ ID NO: 494126 - DNA, 15 bp, Homo sapiens
ctctaaatcagctgc

SEQ ID NO: 494127 - DNA, 15 bp, Homo sapiens
tctaaatcagctgca

SEQ ID NO: 494128 - DNA, 15 bp, Homo sapiens
ctaaatcagctgcag

SEQ ID NO: 494129 - DNA, 15 bp, Homo sapiens
taaatcagctgcagt

SEQ ID NO: 494130 - DNA, 15 bp, Homo sapiens
aaatcagctgcagtg

SEQ ID NO: 494131 - DNA, 15 bp, Homo sapiens
aatcagctgcagtga

SEQ ID NO: 494132 - DNA, 15 bp, Homo sapiens
atcagctgcagtgat

SEQ ID NO: 494133 - DNA, 15 bp, Homo sapiens
tcagctgcagtgata

SEQ ID NO: 494134 - DNA, 15 bp, Homo sapiens
cagctgcagtgatag

SEQ ID NO: 494135 - DNA, 15 bp, Homo sapiens
agctgcagtgataga

SEQ ID NO: 494136 - DNA, 15 bp, Homo sapiens
gctgcagtgatagaa

SEQ ID NO: 494137 - DNA, 15 bp, Homo sapiens
ctgcagtgatagaaa

SEQ ID NO: 494138 - DNA, 15 bp, Homo sapiens
tgcagtgatagaaag

SEQ ID NO: 494139 - DNA, 15 bp, Homo sapiens
gcagtgatagaaagc

SEQ ID NO: 494140 - DNA, 15 bp, Homo sapiens
cagtgatagaaagca

SEQ ID NO: 494141 - DNA, 15 bp, Homo sapiens
agtgatagaaagcag

SEQ ID NO: 494142 - DNA, 15 bp, Homo sapiens
gtgatagaaagcaga

SEQ ID NO: 494143 - DNA, 15 bp, Homo sapiens
tgatagaaagcagac

SEQ ID NO: 494144 - DNA, 15 bp, Homo sapiens
gatagaaagcagact

SEQ ID NO: 494145 - DNA, 15 bp, Homo sapiens
atagaaagcagacta

SEQ ID NO: 494146 - DNA, 15 bp, Homo sapiens
tagaaagcagactag

SEQ ID NO: 494147 - DNA, 15 bp, Homo sapiens
agaaagcagactagg

SEQ ID NO: 494148 - DNA, 15 bp, Homo sapiens
gaaagcagactaggt

SEQ ID NO: 494149 - DNA, 15 bp, Homo sapiens
aaagcagactaggta

SEQ ID NO: 494150 - DNA, 15 bp, Homo sapiens
aagcagactaggtaa

SEQ ID NO: 494151 - DNA, 15 bp, Homo sapiens
agcagactaggtaac

SEQ ID NO: 494152 - DNA, 15 bp, Homo sapiens
gcagactaggtaact

SEQ ID NO: 494153 - DNA, 15 bp, Homo sapiens
cagactaggtaactt

SEQ ID NO: 494154 - DNA, 15 bp, Homo sapiens
agactaggtaacttc

SEQ ID NO: 494155 - DNA, 15 bp, Homo sapiens
gactaggtaacttca

SEQ ID NO: 494156 - DNA, 15 bp, Homo sapiens
actaggtaacttcag

SEQ ID NO: 494157 - DNA, 15 bp, Homo sapiens
ctaggtaacttcagc

SEQ ID NO: 494158 - DNA, 15 bp, Homo sapiens
taggtaacttcagca

SEQ ID NO: 494159 - DNA, 15 bp, Homo sapiens
aggtaacttcagcat

SEQ ID NO: 494160 - DNA, 15 bp, Homo sapiens
ggtaacttcagcatg

SEQ ID NO: 494161 - DNA, 15 bp, Homo sapiens
gtaacttcagcatga

SEQ ID NO: 494162 - DNA, 15 bp, Homo sapiens
taacttcagcatgag

SEQ ID NO: 494163 - DNA, 15 bp, Homo sapiens
aacttcagcatgaga

SEQ ID NO: 494164 - DNA, 15 bp, Homo sapiens
acttcagcatgagag

SEQ ID NO: 494165 - DNA, 15 bp, Homo sapiens
cttcagcatgagagg

SEQ ID NO: 494166 - DNA, 15 bp, Homo sapiens
ttcagcatgagaggg

SEQ ID NO: 494167 - DNA, 15 bp, Homo sapiens
tcagcatgagaggga

SEQ ID NO: 494168 - DNA, 15 bp, Homo sapiens
cagcatgagagggag

SEQ ID NO: 494169 - DNA, 15 bp, Homo sapiens
agcatgagagggagg

SEQ ID NO: 494170 - DNA, 15 bp, Homo sapiens
gcatgagagggaggg

SEQ ID NO: 494171 - DNA, 15 bp, Homo sapiens
catgagagggaggga

SEQ ID NO: 494172 - DNA, 15 bp, Homo sapiens
atgagagggagggac

SEQ ID NO: 494173 - DNA, 15 bp, Homo sapiens
tgagagggagggacc

SEQ ID NO: 494174 - DNA, 15 bp, Homo sapiens
gagagggagggacct

SEQ ID NO: 494175 - DNA, 15 bp, Homo sapiens
agagggagggacctc

SEQ ID NO: 494176 - DNA, 15 bp, Homo sapiens
gagggagggacctca

SEQ ID NO: 494177 - DNA, 15 bp, Homo sapiens
agggagggacctcat

SEQ ID NO: 494178 - DNA, 15 bp, Homo sapiens
gggagggacctcatt

SEQ ID NO: 494179 - DNA, 15 bp, Homo sapiens
ggagggacctcattg

SEQ ID NO: 494180 - DNA, 15 bp, Homo sapiens
gagggacctcattgc

SEQ ID NO: 494181 - DNA, 15 bp, Homo sapiens
agggacctcattgca

SEQ ID NO: 494182 - DNA, 15 bp, Homo sapiens
gggacctcattgcag

SEQ ID NO: 494183 - DNA, 15 bp, Homo sapiens
ggacctcattgcagg

SEQ ID NO: 494184 - DNA, 15 bp, Homo sapiens
gacctcattgcagga

SEQ ID NO: 494185 - DNA, 15 bp, Homo sapiens
acctcattgcaggaa

SEQ ID NO: 494186 - DNA, 15 bp, Homo sapiens
cctcattgcaggaag

SEQ ID NO: 494187 - DNA, 15 bp, Homo sapiens
ctcattgcaggaagc

SEQ ID NO: 494188 - DNA, 15 bp, Homo sapiens
tcattgcaggaagca

SEQ ID NO: 494189 - DNA, 15 bp, Homo sapiens
cattgcaggaagcaa

SEQ ID NO: 494190 - DNA, 15 bp, Homo sapiens
attgcaggaagcaaa

SEQ ID NO: 494191 - DNA, 15 bp, Homo sapiens
ttgcaggaagcaaaa

SEQ ID NO: 494192 - DNA, 15 bp, Homo sapiens
tgcaggaagcaaaag

SEQ ID NO: 494193 - DNA, 15 bp, Homo sapiens
gcaggaagcaaaagt

SEQ ID NO: 494194 - DNA, 15 bp, Homo sapiens
caggaagcaaaagtc

SEQ ID NO: 494195 - DNA, 15 bp, Homo sapiens
aggaagcaaaagtca

SEQ ID NO: 494196 - DNA, 15 bp, Homo sapiens
ggaagcaaaagtcac

SEQ ID NO: 494197 - DNA, 15 bp, Homo sapiens
gaagcaaaagtcaca

SEQ ID NO: 494198 - DNA, 15 bp, Homo sapiens
aagcaaaagtcacag

SEQ ID NO: 494199 - DNA, 15 bp, Homo sapiens
agcaaaagtcacagt

SEQ ID NO: 494200 - DNA, 15 bp, Homo sapiens
gcaaaagtcacagta

SEQ ID NO: 494201 - DNA, 15 bp, Homo sapiens
caaaagtcacagtag

SEQ ID NO: 494202 - DNA, 15 bp, Homo sapiens
aaaagtcacagtaga

SEQ ID NO: 494203 - DNA, 15 bp, Homo sapiens
aaagtcacagtagag

SEQ ID NO: 494204 - DNA, 15 bp, Homo sapiens
aagtcacagtagagt

SEQ ID NO: 494205 - DNA, 15 bp, Homo sapiens
agtcacagtagagtt

SEQ ID NO: 494206 - DNA, 15 bp, Homo sapiens
gtcacagtagagtta

SEQ ID NO: 494207 - DNA, 15 bp, Homo sapiens
tcacagtagagttaa

SEQ ID NO: 494208 - DNA, 15 bp, Homo sapiens
cacagtagagttaag

SEQ ID NO: 494209 - DNA, 15 bp, Homo sapiens
acagtagagttaaga

SEQ ID NO: 494210 - DNA, 15 bp, Homo sapiens
cagtagagttaagac

SEQ ID NO: 494211 - DNA, 15 bp, Homo sapiens
agtagagttaagact

SEQ ID NO: 494212 - DNA, 15 bp, Homo sapiens
gtagagttaagactc

SEQ ID NO: 494213 - DNA, 15 bp, Homo sapiens
tagagttaagactct

SEQ ID NO: 494214 - DNA, 15 bp, Homo sapiens
agagttaagactctt

SEQ ID NO: 494215 - DNA, 15 bp, Homo sapiens
gagttaagactcttg

SEQ ID NO: 494216 - DNA, 15 bp, Homo sapiens
agttaagactcttga

SEQ ID NO: 494217 - DNA, 15 bp, Homo sapiens
gttaagactcttgaa

SEQ ID NO: 494218 - DNA, 15 bp, Homo sapiens
ttaagactcttgaaa

SEQ ID NO: 494219 - DNA, 15 bp, Homo sapiens
taagactcttgaaag

SEQ ID NO: 494220 - DNA, 15 bp, Homo sapiens
aagactcttgaaaga

SEQ ID NO: 494221 - DNA, 15 bp, Homo sapiens
agactcttgaaagaa

SEQ ID NO: 494222 - DNA, 15 bp, Homo sapiens
gactcttgaaagaag

SEQ ID NO: 494223 - DNA, 15 bp, Homo sapiens
actcttgaaagaagc

SEQ ID NO: 494224 - DNA, 15 bp, Homo sapiens
ctcttgaaagaagca

SEQ ID NO: 494225 - DNA, 15 bp, Homo sapiens
tcttgaaagaagcac

SEQ ID NO: 494226 - DNA, 15 bp, Homo sapiens
cttgaaagaagcact

SEQ ID NO: 494227 - DNA, 15 bp, Homo sapiens
ttgaaagaagcactt

SEQ ID NO: 494228 - DNA, 15 bp, Homo sapiens
tgaaagaagcacttt

SEQ ID NO: 494229 - DNA, 15 bp, Homo sapiens
gaaagaagcactttt

SEQ ID NO: 494230 - DNA, 15 bp, Homo sapiens
aaagaagcactttta

SEQ ID NO: 494231 - DNA, 15 bp, Homo sapiens
aagaagcacttttat

SEQ ID NO: 494232 - DNA, 15 bp, Homo sapiens
agaagcacttttatt

SEQ ID NO: 494233 - DNA, 15 bp, Homo sapiens
gaagcacttttattt

SEQ ID NO: 494234 - DNA, 15 bp, Homo sapiens
aagcacttttatttt

SEQ ID NO: 494235 - DNA, 15 bp, Homo sapiens
agcacttttattttc

SEQ ID NO: 494236 - DNA, 15 bp, Homo sapiens
gcacttttattttct

SEQ ID NO: 494237 - DNA, 15 bp, Homo sapiens
cacttttattttctt

SEQ ID NO: 494238 - DNA, 15 bp, Homo sapiens
acttttattttcttg

SEQ ID NO: 494239 - DNA, 15 bp, Homo sapiens
cttttattttcttga

SEQ ID NO: 494240 - DNA, 15 bp, Homo sapiens
ttttattttcttgaa

SEQ ID NO: 494241 - DNA, 15 bp, Homo sapiens
tttattttcttgaag

SEQ ID NO: 494242 - DNA, 15 bp, Homo sapiens
ttattttcttgaaga

SEQ ID NO: 494243 - DNA, 15 bp, Homo sapiens
tattttcttgaagaa

SEQ ID NO: 494244 - DNA, 15 bp, Homo sapiens
attttcttgaagaat

SEQ ID NO: 494245 - DNA, 15 bp, Homo sapiens
ttttcttgaagaatt

SEQ ID NO: 494246 - DNA, 15 bp, Homo sapiens
tttcttgaagaattg

SEQ ID NO: 494247 - DNA, 15 bp, Homo sapiens
ttcttgaagaattga

SEQ ID NO: 494248 - DNA, 15 bp, Homo sapiens
tcttgaagaattgac

SEQ ID NO: 494249 - DNA, 15 bp, Homo sapiens
cttgaagaattgaca

SEQ ID NO: 494250 - DNA, 15 bp, Homo sapiens
ttgaagaattgacag

SEQ ID NO: 494251 - DNA, 15 bp, Homo sapiens
tgaagaattgacaga

SEQ ID NO: 494252 - DNA, 15 bp, Homo sapiens
gaagaattgacagat

SEQ ID NO: 494253 - DNA, 15 bp, Homo sapiens
aagaattgacagatc

SEQ ID NO: 494254 - DNA, 15 bp, Homo sapiens
agaattgacagatct

SEQ ID NO: 494255 - DNA, 15 bp, Homo sapiens
gaattgacagatctc

SEQ ID NO: 494256 - DNA, 15 bp, Homo sapiens
aattgacagatctct

SEQ ID NO: 494257 - DNA, 15 bp, Homo sapiens
attgacagatctctg

SEQ ID NO: 494258 - DNA, 15 bp, Homo sapiens
ttgacagatctctgc

SEQ ID NO: 494259 - DNA, 15 bp, Homo sapiens
tgacagatctctgct

SEQ ID NO: 494260 - DNA, 15 bp, Homo sapiens
gacagatctctgctt

SEQ ID NO: 494261 - DNA, 15 bp, Homo sapiens
acagatctctgcttc

SEQ ID NO: 494262 - DNA, 15 bp, Homo sapiens
cagatctctgcttcc

SEQ ID NO: 494263 - DNA, 15 bp, Homo sapiens
agatctctgcttcct

SEQ ID NO: 494264 - DNA, 15 bp, Homo sapiens
gatctctgcttcctg

SEQ ID NO: 494265 - DNA, 15 bp, Homo sapiens
atctctgcttcctgt

SEQ ID NO: 494266 - DNA, 15 bp, Homo sapiens
tctctgcttcctgta

SEQ ID NO: 494267 - DNA, 15 bp, Homo sapiens
ctctgcttcctgtaa

SEQ ID NO: 494268 - DNA, 15 bp, Homo sapiens
tctgcttcctgtaat

SEQ ID NO: 494269 - DNA, 15 bp, Homo sapiens
ctgcttcctgtaatg

SEQ ID NO: 494270 - DNA, 15 bp, Homo sapiens
tgcttcctgtaatgt

SEQ ID NO: 494271 - DNA, 15 bp, Homo sapiens
gcttcctgtaatgtt

SEQ ID NO: 494272 - DNA, 15 bp, Homo sapiens
cttcctgtaatgttt

SEQ ID NO: 494273 - DNA, 15 bp, Homo sapiens
ttcctgtaatgtttt

SEQ ID NO: 494274 - DNA, 15 bp, Homo sapiens
tcctgtaatgttttg

SEQ ID NO: 494275 - DNA, 15 bp, Homo sapiens
cctgtaatgttttgt

SEQ ID NO: 494276 - DNA, 15 bp, Homo sapiens
ctgtaatgttttgtg

SEQ ID NO: 494277 - DNA, 15 bp, Homo sapiens
tgtaatgttttgtgc

SEQ ID NO: 494278 - DNA, 15 bp, Homo sapiens
gtaatgttttgtgca

SEQ ID NO: 494279 - DNA, 15 bp, Homo sapiens
taatgttttgtgcaa

SEQ ID NO: 494280 - DNA, 15 bp, Homo sapiens
aatgttttgtgcaaa

SEQ ID NO: 494281 - DNA, 15 bp, Homo sapiens
atgttttgtgcaaat

SEQ ID NO: 494282 - DNA, 15 bp, Homo sapiens
tgttttgtgcaaatt

SEQ ID NO: 494283 - DNA, 15 bp, Homo sapiens
gttttgtgcaaattt

SEQ ID NO: 494284 - DNA, 15 bp, Homo sapiens
ttttgtgcaaatttc

SEQ ID NO: 494285 - DNA, 15 bp, Homo sapiens
tttgtgcaaatttct

SEQ ID NO: 494286 - DNA, 15 bp, Homo sapiens
ttgtgcaaatttctg

SEQ ID NO: 494287 - DNA, 15 bp, Homo sapiens
tgtgcaaatttctga

SEQ ID NO: 494288 - DNA, 15 bp, Homo sapiens
gtgcaaatttctgac

SEQ ID NO: 494289 - DNA, 15 bp, Homo sapiens
tgcaaatttctgaca

SEQ ID NO: 494290 - DNA, 15 bp, Homo sapiens
gcaaatttctgacag

SEQ ID NO: 494291 - DNA, 15 bp, Homo sapiens
caaatttctgacagt

SEQ ID NO: 494292 - DNA, 15 bp, Homo sapiens
aaatttctgacagtg

SEQ ID NO: 494293 - DNA, 15 bp, Homo sapiens
aatttctgacagtgc

SEQ ID NO: 494294 - DNA, 15 bp, Homo sapiens
atttctgacagtgct

SEQ ID NO: 494295 - DNA, 15 bp, Homo sapiens
tttctgacagtgcta

SEQ ID NO: 494296 - DNA, 15 bp, Homo sapiens
ttctgacagtgctat

SEQ ID NO: 494297 - DNA, 15 bp, Homo sapiens
tctgacagtgctatt

SEQ ID NO: 494298 - DNA, 15 bp, Homo sapiens
ctgacagtgctattt

SEQ ID NO: 494299 - DNA, 15 bp, Homo sapiens
tgacagtgctatttt

SEQ ID NO: 494300 - DNA, 15 bp, Homo sapiens
gacagtgctattttc

SEQ ID NO: 494301 - DNA, 15 bp, Homo sapiens
acagtgctattttcc

SEQ ID NO: 494302 - DNA, 15 bp, Homo sapiens
cagtgctattttccc

SEQ ID NO: 494303 - DNA, 15 bp, Homo sapiens
agtgctattttccct

SEQ ID NO: 494304 - DNA, 15 bp, Homo sapiens
gtgctattttccctt

SEQ ID NO: 494305 - DNA, 15 bp, Homo sapiens
tgctattttcccttc

SEQ ID NO: 494306 - DNA, 15 bp, Homo sapiens
gctattttcccttcc

SEQ ID NO: 494307 - DNA, 15 bp, Homo sapiens
ctattttcccttccc

SEQ ID NO: 494308 - DNA, 15 bp, Homo sapiens
tattttcccttccca

SEQ ID NO: 494309 - DNA, 15 bp, Homo sapiens
attttcccttcccat

SEQ ID NO: 494310 - DNA, 15 bp, Homo sapiens
ttttcccttcccata

SEQ ID NO: 494311 - DNA, 15 bp, Homo sapiens
tttcccttcccatag

SEQ ID NO: 494312 - DNA, 15 bp, Homo sapiens
ttcccttcccatagg

SEQ ID NO: 494313 - DNA, 15 bp, Homo sapiens
tcccttcccataggc

SEQ ID NO: 494314 - DNA, 15 bp, Homo sapiens
cccttcccataggca

SEQ ID NO: 494315 - DNA, 15 bp, Homo sapiens
ccttcccataggcaa

SEQ ID NO: 494316 - DNA, 15 bp, Homo sapiens
cttcccataggcaat

SEQ ID NO: 494317 - DNA, 15 bp, Homo sapiens
ttcccataggcaatg

SEQ ID NO: 494318 - DNA, 15 bp, Homo sapiens
tcccataggcaatgt

SEQ ID NO: 494319 - DNA, 15 bp, Homo sapiens
cccataggcaatgtg

SEQ ID NO: 494320 - DNA, 15 bp, Homo sapiens
ccataggcaatgtga

SEQ ID NO: 494321 - DNA, 15 bp, Homo sapiens
cataggcaatgtgaa

SEQ ID NO: 494322 - DNA, 15 bp, Homo sapiens
ataggcaatgtgaag

SEQ ID NO: 494323 - DNA, 15 bp, Homo sapiens
taggcaatgtgaagt

SEQ ID NO: 494324 - DNA, 15 bp, Homo sapiens
aggcaatgtgaagta

SEQ ID NO: 494325 - DNA, 15 bp, Homo sapiens
ggcaatgtgaagtat

SEQ ID NO: 494326 - DNA, 15 bp, Homo sapiens
gcaatgtgaagtatt

SEQ ID NO: 494327 - DNA, 15 bp, Homo sapiens
caatgtgaagtattc

SEQ ID NO: 494328 - DNA, 15 bp, Homo sapiens
aatgtgaagtattca

SEQ ID NO: 494329 - DNA, 15 bp, Homo sapiens
atgtgaagtattcat

SEQ ID NO: 494330 - DNA, 15 bp, Homo sapiens
tgtgaagtattcatc

SEQ ID NO: 494331 - DNA, 15 bp, Homo sapiens
gtgaagtattcatcc

SEQ ID NO: 494332 - DNA, 15 bp, Homo sapiens
tgaagtattcatccg

SEQ ID NO: 494333 - DNA, 15 bp, Homo sapiens
gaagtattcatccgg

SEQ ID NO: 494334 - DNA, 15 bp, Homo sapiens
aagtattcatccggc

SEQ ID NO: 494335 - DNA, 15 bp, Homo sapiens
agtattcatccggcc

SEQ ID NO: 494336 - DNA, 15 bp, Homo sapiens
gtattcatccggcca

SEQ ID NO: 494337 - DNA, 15 bp, Homo sapiens
tattcatccggccaa

SEQ ID NO: 494338 - DNA, 15 bp, Homo sapiens
attcatccggccaac

SEQ ID NO: 494339 - DNA, 15 bp, Homo sapiens
ttcatccggccaacc

SEQ ID NO: 494340 - DNA, 15 bp, Homo sapiens
tcatccggccaacca

SEQ ID NO: 494341 - DNA, 15 bp, Homo sapiens
catccggccaaccaa

SEQ ID NO: 494342 - DNA, 15 bp, Homo sapiens
atccggccaaccaat

SEQ ID NO: 494343 - DNA, 15 bp, Homo sapiens
tccggccaaccaatg

SEQ ID NO: 494344 - DNA, 15 bp, Homo sapiens
ccggccaaccaatgt

SEQ ID NO: 494345 - DNA, 15 bp, Homo sapiens
cggccaaccaatgtt

SEQ ID NO: 494346 - DNA, 15 bp, Homo sapiens
ggccaaccaatgttt

SEQ ID NO: 494347 - DNA, 15 bp, Homo sapiens
gccaaccaatgtttc

SEQ ID NO: 494348 - DNA, 15 bp, Homo sapiens
ccaaccaatgtttcc

SEQ ID NO: 494349 - DNA, 15 bp, Homo sapiens
caaccaatgtttcct

SEQ ID NO: 494350 - DNA, 15 bp, Homo sapiens
aaccaatgtttcctg

SEQ ID NO: 494351 - DNA, 15 bp, Homo sapiens
accaatgtttcctga

SEQ ID NO: 494352 - DNA, 15 bp, Homo sapiens
ccaatgtttcctgac

SEQ ID NO: 494353 - DNA, 15 bp, Homo sapiens
caatgtttcctgacg

SEQ ID NO: 494354 - DNA, 15 bp, Homo sapiens
aatgtttcctgacgt

SEQ ID NO: 494355 - DNA, 15 bp, Homo sapiens
atgtttcctgacgta

SEQ ID NO: 494356 - DNA, 15 bp, Homo sapiens
tgtttcctgacgtac

SEQ ID NO: 494357 - DNA, 15 bp, Homo sapiens
gtttcctgacgtaca

SEQ ID NO: 494358 - DNA, 15 bp, Homo sapiens
tttcctgacgtacag

SEQ ID NO: 494359 - DNA, 15 bp, Homo sapiens
ttcctgacgtacagt

SEQ ID NO: 494360 - DNA, 15 bp, Homo sapiens
tcctgacgtacagtg

SEQ ID NO: 494361 - DNA, 15 bp, Homo sapiens
cctgacgtacagtgt

SEQ ID NO: 494362 - DNA, 15 bp, Homo sapiens
ctgacgtacagtgtt

SEQ ID NO: 494363 - DNA, 15 bp, Homo sapiens
tgacgtacagtgttg

SEQ ID NO: 494364 - DNA, 15 bp, Homo sapiens
gacgtacagtgttgc

SEQ ID NO: 494365 - DNA, 15 bp, Homo sapiens
acgtacagtgttgcc

SEQ ID NO: 494366 - DNA, 15 bp, Homo sapiens
cgtacagtgttgccc

SEQ ID NO: 494367 - DNA, 15 bp, Homo sapiens
gtacagtgttgccct

SEQ ID NO: 494368 - DNA, 15 bp, Homo sapiens
tacagtgttgccctt

SEQ ID NO: 494369 - DNA, 15 bp, Homo sapiens
acagtgttgcccttt

SEQ ID NO: 494370 - DNA, 15 bp, Homo sapiens
cagtgttgccctttt

SEQ ID NO: 494371 - DNA, 15 bp, Homo sapiens
agtgttgcccttttc

SEQ ID NO: 494372 - DNA, 15 bp, Homo sapiens
gtgttgcccttttca

SEQ ID NO: 494373 - DNA, 15 bp, Homo sapiens
tgttgcccttttcag

SEQ ID NO: 494374 - DNA, 15 bp, Homo sapiens
gttgcccttttcagc

SEQ ID NO: 494375 - DNA, 15 bp, Homo sapiens
ttgcccttttcagca

SEQ ID NO: 494376 - DNA, 15 bp, Homo sapiens
tgcccttttcagcaa

SEQ ID NO: 494377 - DNA, 15 bp, Homo sapiens
gcccttttcagcaaa

SEQ ID NO: 494378 - DNA, 15 bp, Homo sapiens
cccttttcagcaaat

SEQ ID NO: 494379 - DNA, 15 bp, Homo sapiens
ccttttcagcaaatg

SEQ ID NO: 494380 - DNA, 15 bp, Homo sapiens
cttttcagcaaatgc

SEQ ID NO: 494381 - DNA, 15 bp, Homo sapiens
ttttcagcaaatgcc

SEQ ID NO: 494382 - DNA, 15 bp, Homo sapiens
tttcagcaaatgcca

SEQ ID NO: 494383 - DNA, 15 bp, Homo sapiens
ttcagcaaatgccaa

SEQ ID NO: 494384 - DNA, 15 bp, Homo sapiens
tcagcaaatgccaat

SEQ ID NO: 494385 - DNA, 15 bp, Homo sapiens
cagcaaatgccaatt

SEQ ID NO: 494386 - DNA, 15 bp, Homo sapiens
agcaaatgccaattc

SEQ ID NO: 494387 - DNA, 15 bp, Homo sapiens
gcaaatgccaattcc

SEQ ID NO: 494388 - DNA, 15 bp, Homo sapiens
caaatgccaattcca

SEQ ID NO: 494389 - DNA, 15 bp, Homo sapiens
aaatgccaattccaa

SEQ ID NO: 494390 - DNA, 15 bp, Homo sapiens
aatgccaattccaag

SEQ ID NO: 494391 - DNA, 15 bp, Homo sapiens
atgccaattccaagt

SEQ ID NO: 494392 - DNA, 15 bp, Homo sapiens
tgccaattccaagtt

SEQ ID NO: 494393 - DNA, 15 bp, Homo sapiens
gccaattccaagttc

SEQ ID NO: 494394 - DNA, 15 bp, Homo sapiens
ccaattccaagttcc

SEQ ID NO: 494395 - DNA, 15 bp, Homo sapiens
caattccaagttcca

SEQ ID NO: 494396 - DNA, 15 bp, Homo sapiens
aattccaagttccat

SEQ ID NO: 494397 - DNA, 15 bp, Homo sapiens
attccaagttccatt

SEQ ID NO: 494398 - DNA, 15 bp, Homo sapiens
ttccaagttccatta

SEQ ID NO: 494399 - DNA, 15 bp, Homo sapiens
tccaagttccattaa

SEQ ID NO: 494400 - DNA, 15 bp, Homo sapiens
ccaagttccattaaa

SEQ ID NO: 494401 - DNA, 15 bp, Homo sapiens
caagttccattaaat

SEQ ID NO: 494402 - DNA, 15 bp, Homo sapiens
aagttccattaaatc

SEQ ID NO: 494403 - DNA, 15 bp, Homo sapiens
agttccattaaatca

SEQ ID NO: 494404 - DNA, 15 bp, Homo sapiens
gttccattaaatcag

SEQ ID NO: 494405 - DNA, 15 bp, Homo sapiens
ttccattaaatcaga

SEQ ID NO: 494406 - DNA, 15 bp, Homo sapiens
tccattaaatcagaa

SEQ ID NO: 494407 - DNA, 15 bp, Homo sapiens
ccattaaatcagaag

SEQ ID NO: 494408 - DNA, 15 bp, Homo sapiens
cattaaatcagaagc

SEQ ID NO: 494409 - DNA, 15 bp, Homo sapiens
attaaatcagaagct

SEQ ID NO: 494410 - DNA, 15 bp, Homo sapiens
ttaaatcagaagctc

SEQ ID NO: 494411 - DNA, 15 bp, Homo sapiens
taaatcagaagctcc

SEQ ID NO: 494412 - DNA, 15 bp, Homo sapiens
aaatcagaagctcca

SEQ ID NO: 494413 - DNA, 15 bp, Homo sapiens
aatcagaagctccat

SEQ ID NO: 494414 - DNA, 15 bp, Homo sapiens
atcagaagctccatg

SEQ ID NO: 494415 - DNA, 15 bp, Homo sapiens
tcagaagctccatgg

SEQ ID NO: 494416 - DNA, 15 bp, Homo sapiens
cagaagctccatggc

SEQ ID NO: 494417 - DNA, 15 bp, Homo sapiens
agaagctccatggct

SEQ ID NO: 494418 - DNA, 15 bp, Homo sapiens
gaagctccatggctc

SEQ ID NO: 494419 - DNA, 15 bp, Homo sapiens
aagctccatggctcc

SEQ ID NO: 494420 - DNA, 15 bp, Homo sapiens
agctccatggctcct

SEQ ID NO: 494421 - DNA, 15 bp, Homo sapiens
gctccatggctcctt

SEQ ID NO: 494422 - DNA, 15 bp, Homo sapiens
ctccatggctccttg

SEQ ID NO: 494423 - DNA, 15 bp, Homo sapiens
tccatggctccttgg

SEQ ID NO: 494424 - DNA, 15 bp, Homo sapiens
ccatggctccttggc

SEQ ID NO: 494425 - DNA, 15 bp, Homo sapiens
catggctccttggcc

SEQ ID NO: 494426 - DNA, 15 bp, Homo sapiens
atggctccttggccc

SEQ ID NO: 494427 - DNA, 15 bp, Homo sapiens
tggctccttggccca

SEQ ID NO: 494428 - DNA, 15 bp, Homo sapiens
ggctccttggcccac

SEQ ID NO: 494429 - DNA, 15 bp, Homo sapiens
gctccttggcccacg

SEQ ID NO: 494430 - DNA, 15 bp, Homo sapiens
ctccttggcccacga

SEQ ID NO: 494431 - DNA, 15 bp, Homo sapiens
tccttggcccacgat

SEQ ID NO: 494432 - DNA, 15 bp, Homo sapiens
ccttggcccacgatg

SEQ ID NO: 494433 - DNA, 15 bp, Homo sapiens
cttggcccacgatgt

SEQ ID NO: 494434 - DNA, 15 bp, Homo sapiens
ttggcccacgatgtt

SEQ ID NO: 494435 - DNA, 15 bp, Homo sapiens
tggcccacgatgttg

SEQ ID NO: 494436 - DNA, 15 bp, Homo sapiens
ggcccacgatgttga

SEQ ID NO: 494437 - DNA, 15 bp, Homo sapiens
gcccacgatgttgag

SEQ ID NO: 494438 - DNA, 15 bp, Homo sapiens
cccacgatgttgagt

SEQ ID NO: 494439 - DNA, 15 bp, Homo sapiens
ccacgatgttgagtg

SEQ ID NO: 494440 - DNA, 15 bp, Homo sapiens
cacgatgttgagtgc

SEQ ID NO: 494441 - DNA, 15 bp, Homo sapiens
acgatgttgagtgct

SEQ ID NO: 494442 - DNA, 15 bp, Homo sapiens
cgatgttgagtgctg

SEQ ID NO: 494443 - DNA, 15 bp, Homo sapiens
gatgttgagtgctga

SEQ ID NO: 494444 - DNA, 15 bp, Homo sapiens
atgttgagtgctgac

SEQ ID NO: 494445 - DNA, 15 bp, Homo sapiens
tgttgagtgctgact

SEQ ID NO: 494446 - DNA, 15 bp, Homo sapiens
gttgagtgctgactg

SEQ ID NO: 494447 - DNA, 15 bp, Homo sapiens
ttgagtgctgactgt

SEQ ID NO: 494448 - DNA, 15 bp, Homo sapiens
tgagtgctgactgtg

SEQ ID NO: 494449 - DNA, 15 bp, Homo sapiens
gagtgctgactgtgt

SEQ ID NO: 494450 - DNA, 15 bp, Homo sapiens
agtgctgactgtgtg

SEQ ID NO: 494451 - DNA, 15 bp, Homo sapiens
gtgctgactgtgtgt

SEQ ID NO: 494452 - DNA, 15 bp, Homo sapiens
tgctgactgtgtgtt

SEQ ID NO: 494453 - DNA, 15 bp, Homo sapiens
gctgactgtgtgttc

SEQ ID NO: 494454 - DNA, 15 bp, Homo sapiens
ctgactgtgtgttct

SEQ ID NO: 494455 - DNA, 15 bp, Homo sapiens
tgactgtgtgttcta

SEQ ID NO: 494456 - DNA, 15 bp, Homo sapiens
gactgtgtgttctac

SEQ ID NO: 494457 - DNA, 15 bp, Homo sapiens
actgtgtgttctact

SEQ ID NO: 494458 - DNA, 15 bp, Homo sapiens
ctgtgtgttctactg

SEQ ID NO: 494459 - DNA, 15 bp, Homo sapiens
tgtgtgttctactga

SEQ ID NO: 494460 - DNA, 15 bp, Homo sapiens
gtgtgttctactgaa

SEQ ID NO: 494461 - DNA, 15 bp, Homo sapiens
tgtgttctactgaaa

SEQ ID NO: 494462 - DNA, 15 bp, Homo sapiens
gtgttctactgaaag

SEQ ID NO: 494463 - DNA, 15 bp, Homo sapiens
tgttctactgaaaga

SEQ ID NO: 494464 - DNA, 15 bp, Homo sapiens
gttctactgaaagag

SEQ ID NO: 494465 - DNA, 15 bp, Homo sapiens
ttctactgaaagagt

SEQ ID NO: 494466 - DNA, 15 bp, Homo sapiens
tctactgaaagagta

SEQ ID NO: 494467 - DNA, 15 bp, Homo sapiens
ctactgaaagagtaa

SEQ ID NO: 494468 - DNA, 15 bp, Homo sapiens
tactgaaagagtaaa

SEQ ID NO: 494469 - DNA, 15 bp, Homo sapiens
actgaaagagtaaaa

SEQ ID NO: 494470 - DNA, 15 bp, Homo sapiens
ctgaaagagtaaaac

SEQ ID NO: 494471 - DNA, 15 bp, Homo sapiens
tgaaagagtaaaaca

SEQ ID NO: 494472 - DNA, 15 bp, Homo sapiens
gaaagagtaaaacac

SEQ ID NO: 494473 - DNA, 15 bp, Homo sapiens
aaagagtaaaacact

SEQ ID NO: 494474 - DNA, 15 bp, Homo sapiens
aagagtaaaacactg

SEQ ID NO: 494475 - DNA, 15 bp, Homo sapiens
agagtaaaacactga

SEQ ID NO: 494476 - DNA, 15 bp, Homo sapiens
gagtaaaacactgac

SEQ ID NO: 494477 - DNA, 15 bp, Homo sapiens
agtaaaacactgact

SEQ ID NO: 494478 - DNA, 15 bp, Homo sapiens
gtaaaacactgacta

SEQ ID NO: 494479 - DNA, 15 bp, Homo sapiens
taaaacactgactat

SEQ ID NO: 494480 - DNA, 15 bp, Homo sapiens
aaaacactgactatc

SEQ ID NO: 494481 - DNA, 15 bp, Homo sapiens
aaacactgactatcc

SEQ ID NO: 494482 - DNA, 15 bp, Homo sapiens
aacactgactatcca

SEQ ID NO: 494483 - DNA, 15 bp, Homo sapiens
acactgactatccaa

SEQ ID NO: 494484 - DNA, 15 bp, Homo sapiens
cactgactatccaaa

SEQ ID NO: 494485 - DNA, 15 bp, Homo sapiens
actgactatccaaag

SEQ ID NO: 494486 - DNA, 15 bp, Homo sapiens
ctgactatccaaaga

SEQ ID NO: 494487 - DNA, 15 bp, Homo sapiens
tgactatccaaagag

SEQ ID NO: 494488 - DNA, 15 bp, Homo sapiens
gactatccaaagaga

SEQ ID NO: 494489 - DNA, 15 bp, Homo sapiens
actatccaaagagaa

SEQ ID NO: 494490 - DNA, 15 bp, Homo sapiens
ctatccaaagagaaa

SEQ ID NO: 494491 - DNA, 15 bp, Homo sapiens
tatccaaagagaaat

SEQ ID NO: 494492 - DNA, 15 bp, Homo sapiens
atccaaagagaaatg

SEQ ID NO: 494493 - DNA, 15 bp, Homo sapiens
tccaaagagaaatgg

SEQ ID NO: 494494 - DNA, 15 bp, Homo sapiens
ccaaagagaaatgga

SEQ ID NO: 494495 - DNA, 15 bp, Homo sapiens
caaagagaaatggat

SEQ ID NO: 494496 - DNA, 15 bp, Homo sapiens
aaagagaaatggata

SEQ ID NO: 494497 - DNA, 15 bp, Homo sapiens
aagagaaatggatat

SEQ ID NO: 494498 - DNA, 15 bp, Homo sapiens
agagaaatggatatt

SEQ ID NO: 494499 - DNA, 15 bp, Homo sapiens
gagaaatggatattt

SEQ ID NO: 494500 - DNA, 15 bp, Homo sapiens
agaaatggatatttt

SEQ ID NO: 494501 - DNA, 15 bp, Homo sapiens
gaaatggatattttg

SEQ ID NO: 494502 - DNA, 15 bp, Homo sapiens
aaatggatattttgt

SEQ ID NO: 494503 - DNA, 15 bp, Homo sapiens
aatggatattttgtt

SEQ ID NO: 494504 - DNA, 15 bp, Homo sapiens
atggatattttgttt

SEQ ID NO: 494505 - DNA, 15 bp, Homo sapiens
tggatattttgtttt

SEQ ID NO: 494506 - DNA, 15 bp, Homo sapiens
ggatattttgttttt

SEQ ID NO: 494507 - DNA, 15 bp, Homo sapiens
gatattttgttttta

SEQ ID NO: 494508 - DNA, 15 bp, Homo sapiens
atattttgtttttat

SEQ ID NO: 494509 - DNA, 15 bp, Homo sapiens
tattttgtttttata

SEQ ID NO: 494510 - DNA, 15 bp, Homo sapiens
attttgtttttataa

SEQ ID NO: 494511 - DNA, 15 bp, Homo sapiens
ttttgtttttataat

SEQ ID NO: 494512 - DNA, 15 bp, Homo sapiens
tttgtttttataata

SEQ ID NO: 494513 - DNA, 15 bp, Homo sapiens
ttgtttttataataa

SEQ ID NO: 494514 - DNA, 15 bp, Homo sapiens
tgtttttataataac

SEQ ID NO: 494515 - DNA, 15 bp, Homo sapiens
gtttttataataacc

SEQ ID NO: 494516 - DNA, 15 bp, Homo sapiens
tttttataataacca

SEQ ID NO: 494517 - DNA, 15 bp, Homo sapiens
ttttataataaccat

SEQ ID NO: 494518 - DNA, 15 bp, Homo sapiens
tttataataaccata

SEQ ID NO: 494519 - DNA, 15 bp, Homo sapiens
ttataataaccatat

SEQ ID NO: 494520 - DNA, 15 bp, Homo sapiens
tataataaccatata

SEQ ID NO: 494521 - DNA, 15 bp, Homo sapiens
ataataaccatatat

SEQ ID NO: 494522 - DNA, 15 bp, Homo sapiens
taataaccatatatt

SEQ ID NO: 494523 - DNA, 15 bp, Homo sapiens
aataaccatatatta

SEQ ID NO: 494524 - DNA, 15 bp, Homo sapiens
taaccatatattatt

SEQ ID NO: 494525 - DNA, 15 bp, Homo sapiens
aaccatatattattg

SEQ ID NO: 494526 - DNA, 15 bp, Homo sapiens
accatatattattgt

SEQ ID NO: 494527 - DNA, 15 bp, Homo sapiens
ccatatattattgtt

SEQ ID NO: 494528 - DNA, 15 bp, Homo sapiens
catatattattgttt

SEQ ID NO: 494529 - DNA, 15 bp, Homo sapiens
atatattattgtttt

SEQ ID NO: 494530 - DNA, 15 bp, Homo sapiens
tatattattgttttc

SEQ ID NO: 494531 - DNA, 15 bp, Homo sapiens
atattattgttttct

SEQ ID NO: 494532 - DNA, 15 bp, Homo sapiens
tattattgttttctt

SEQ ID NO: 494533 - DNA, 15 bp, Homo sapiens
attattgttttcttc

SEQ ID NO: 494534 - DNA, 15 bp, Homo sapiens
ttattgttttcttct

SEQ ID NO: 494535 - DNA, 15 bp, Homo sapiens
tattgttttcttctt

SEQ ID NO: 494536 - DNA, 15 bp, Homo sapiens
attgttttcttcttc

SEQ ID NO: 494537 - DNA, 15 bp, Homo sapiens
ttgttttcttcttcc

SEQ ID NO: 494538 - DNA, 15 bp, Homo sapiens
tgttttcttcttccc

SEQ ID NO: 494539 - DNA, 15 bp, Homo sapiens
gttttcttcttccct

SEQ ID NO: 494540 - DNA, 15 bp, Homo sapiens
ttttcttcttccctt

SEQ ID NO: 494541 - DNA, 15 bp, Homo sapiens
tttcttcttcccttt

SEQ ID NO: 494542 - DNA, 15 bp, Homo sapiens
ttcttcttccctttc

SEQ ID NO: 494543 - DNA, 15 bp, Homo sapiens
tcttcttccctttct

SEQ ID NO: 494544 - DNA, 15 bp, Homo sapiens
cttcttccctttcta

SEQ ID NO: 494545 - DNA, 15 bp, Homo sapiens
ttcttccctttctat

SEQ ID NO: 494546 - DNA, 15 bp, Homo sapiens
tcttccctttctatg

SEQ ID NO: 494547 - DNA, 15 bp, Homo sapiens
cttccctttctatgc

SEQ ID NO: 494548 - DNA, 15 bp, Homo sapiens
ttccctttctatgca

SEQ ID NO: 494549 - DNA, 15 bp, Homo sapiens
tccctttctatgcaa

SEQ ID NO: 494550 - DNA, 15 bp, Homo sapiens
ccctttctatgcaag

SEQ ID NO: 494551 - DNA, 15 bp, Homo sapiens
cctttctatgcaagt

SEQ ID NO: 494552 - DNA, 15 bp, Homo sapiens
ctttctatgcaagtg

SEQ ID NO: 494553 - DNA, 15 bp, Homo sapiens
tttctatgcaagtgt

SEQ ID NO: 494554 - DNA, 15 bp, Homo sapiens
ttctatgcaagtgta

SEQ ID NO: 494555 - DNA, 15 bp, Homo sapiens
tctatgcaagtgtaa

SEQ ID NO: 494556 - DNA, 15 bp, Homo sapiens
ctatgcaagtgtaaa

SEQ ID NO: 494557 - DNA, 15 bp, Homo sapiens
tatgcaagtgtaaat

SEQ ID NO: 494558 - DNA, 15 bp, Homo sapiens
atgcaagtgtaaatt

SEQ ID NO: 494559 - DNA, 15 bp, Homo sapiens
tgcaagtgtaaatta

SEQ ID NO: 494560 - DNA, 15 bp, Homo sapiens
gcaagtgtaaattaa

SEQ ID NO: 494561 - DNA, 15 bp, Homo sapiens
caagtgtaaattaat

SEQ ID NO: 494562 - DNA, 15 bp, Homo sapiens
aagtgtaaattaatg

SEQ ID NO: 494563 - DNA, 15 bp, Homo sapiens
agtgtaaattaatga

SEQ ID NO: 494564 - DNA, 15 bp, Homo sapiens
gtgtaaattaatgaa

SEQ ID NO: 494565 - DNA, 15 bp, Homo sapiens
tgtaaattaatgaac

SEQ ID NO: 494566 - DNA, 15 bp, Homo sapiens
gtaaattaatgaaca

SEQ ID NO: 494567 - DNA, 15 bp, Homo sapiens
taaattaatgaacag

SEQ ID NO: 494568 - DNA, 15 bp, Homo sapiens
aaattaatgaacaga

SEQ ID NO: 494569 - DNA, 15 bp, Homo sapiens
aattaatgaacagag

SEQ ID NO: 494570 - DNA, 15 bp, Homo sapiens
attaatgaacagaga

SEQ ID NO: 494571 - DNA, 15 bp, Homo sapiens
ttaatgaacagagag

SEQ ID NO: 494572 - DNA, 15 bp, Homo sapiens
taatgaacagagagg

SEQ ID NO: 494573 - DNA, 15 bp, Homo sapiens
aatgaacagagaggt

SEQ ID NO: 494574 - DNA, 15 bp, Homo sapiens
atgaacagagaggta

SEQ ID NO: 494575 - DNA, 15 bp, Homo sapiens
tgaacagagaggtat

SEQ ID NO: 494576 - DNA, 15 bp, Homo sapiens
gaacagagaggtatt

SEQ ID NO: 494577 - DNA, 15 bp, Homo sapiens
aacagagaggtattt

SEQ ID NO: 494578 - DNA, 15 bp, Homo sapiens
acagagaggtatttg

SEQ ID NO: 494579 - DNA, 15 bp, Homo sapiens
cagagaggtatttgg

SEQ ID NO: 494580 - DNA, 15 bp, Homo sapiens
agagaggtatttgga

SEQ ID NO: 494581 - DNA, 15 bp, Homo sapiens
gagaggtatttggaa

SEQ ID NO: 494582 - DNA, 15 bp, Homo sapiens
agaggtatttggaaa

SEQ ID NO: 494583 - DNA, 15 bp, Homo sapiens
gaggtatttggaaat

SEQ ID NO: 494584 - DNA, 15 bp, Homo sapiens
aggtatttggaaatg

SEQ ID NO: 494585 - DNA, 15 bp, Homo sapiens
ggtatttggaaatgg

SEQ ID NO: 494586 - DNA, 15 bp, Homo sapiens
gtatttggaaatggt

SEQ ID NO: 494587 - DNA, 15 bp, Homo sapiens
tatttggaaatggta

SEQ ID NO: 494588 - DNA, 15 bp, Homo sapiens
atttggaaatggtaa

SEQ ID NO: 494589 - DNA, 15 bp, Homo sapiens
tttggaaatggtaat

SEQ ID NO: 494590 - DNA, 15 bp, Homo sapiens
ttggaaatggtaata

SEQ ID NO: 494591 - DNA, 15 bp, Homo sapiens
tggaaatggtaatac

SEQ ID NO: 494592 - DNA, 15 bp, Homo sapiens
ggaaatggtaataca

SEQ ID NO: 494593 - DNA, 15 bp, Homo sapiens
gaaatggtaatacat

SEQ ID NO: 494594 - DNA, 15 bp, Homo sapiens
aaatggtaatacatt

SEQ ID NO: 494595 - DNA, 15 bp, Homo sapiens
aatggtaatacattt

SEQ ID NO: 494596 - DNA, 15 bp, Homo sapiens
atggtaatacatttg

SEQ ID NO: 494597 - DNA, 15 bp, Homo sapiens
tggtaatacatttgt

SEQ ID NO: 494598 - DNA, 15 bp, Homo sapiens
ggtaatacatttgtc

SEQ ID NO: 494599 - DNA, 15 bp, Homo sapiens
gtaatacatttgtca

SEQ ID NO: 494600 - DNA, 15 bp, Homo sapiens
taatacatttgtcac

SEQ ID NO: 494601 - DNA, 15 bp, Homo sapiens
aatacatttgtcacg

SEQ ID NO: 494602 - DNA, 15 bp, Homo sapiens
atacatttgtcacgg

SEQ ID NO: 494603 - DNA, 15 bp, Homo sapiens
tacatttgtcacgga

SEQ ID NO: 494604 - DNA, 15 bp, Homo sapiens
acatttgtcacggat

SEQ ID NO: 494605 - DNA, 15 bp, Homo sapiens
catttgtcacggatt

SEQ ID NO: 494606 - DNA, 15 bp, Homo sapiens
atttgtcacggattt

SEQ ID NO: 494607 - DNA, 15 bp, Homo sapiens
tttgtcacggatttg

SEQ ID NO: 494608 - DNA, 15 bp, Homo sapiens
ttgtcacggatttgt

SEQ ID NO: 494609 - DNA, 15 bp, Homo sapiens
tgtcacggatttgta

SEQ ID NO: 494610 - DNA, 15 bp, Homo sapiens
gtcacggatttgtat

SEQ ID NO: 494611 - DNA, 15 bp, Homo sapiens
tcacggatttgtata

SEQ ID NO: 494612 - DNA, 15 bp, Homo sapiens
cacggatttgtataa

SEQ ID NO: 494613 - DNA, 15 bp, Homo sapiens
acggatttgtataat

SEQ ID NO: 494614 - DNA, 15 bp, Homo sapiens
cggatttgtataatg

SEQ ID NO: 494615 - DNA, 15 bp, Homo sapiens
ggatttgtataatgt

SEQ ID NO: 494616 - DNA, 15 bp, Homo sapiens
gatttgtataatgta

SEQ ID NO: 494617 - DNA, 15 bp, Homo sapiens
atttgtataatgtat

SEQ ID NO: 494618 - DNA, 15 bp, Homo sapiens
tttgtataatgtata

SEQ ID NO: 494619 - DNA, 15 bp, Homo sapiens
ttgtataatgtatac

SEQ ID NO: 494620 - DNA, 15 bp, Homo sapiens
tgtataatgtataca

SEQ ID NO: 494621 - DNA, 15 bp, Homo sapiens
gtataatgtatacag

SEQ ID NO: 494622 - DNA, 15 bp, Homo sapiens
tataatgtatacagc

SEQ ID NO: 494623 - DNA, 15 bp, Homo sapiens
ataatgtatacagca

SEQ ID NO: 494624 - DNA, 15 bp, Homo sapiens
taatgtatacagcat

SEQ ID NO: 494625 - DNA, 15 bp, Homo sapiens
aatgtatacagcatt

SEQ ID NO: 494626 - DNA, 15 bp, Homo sapiens
atgtatacagcattg

SEQ ID NO: 494627 - DNA, 15 bp, Homo sapiens
tgtatacagcattgg

SEQ ID NO: 494628 - DNA, 15 bp, Homo sapiens
gtatacagcattggg

SEQ ID NO: 494629 - DNA, 15 bp, Homo sapiens
tatacagcattggga

SEQ ID NO: 494630 - DNA, 15 bp, Homo sapiens
atacagcattgggaa

SEQ ID NO: 494631 - DNA, 15 bp, Homo sapiens
tacagcattgggaaa

SEQ ID NO: 494632 - DNA, 15 bp, Homo sapiens
acagcattgggaaag

SEQ ID NO: 494633 - DNA, 15 bp, Homo sapiens
cagcattgggaaagt

SEQ ID NO: 494634 - DNA, 15 bp, Homo sapiens
agcattgggaaagtg

SEQ ID NO: 494635 - DNA, 15 bp, Homo sapiens
gcattgggaaagtgg

SEQ ID NO: 494636 - DNA, 15 bp, Homo sapiens
cattgggaaagtggg

SEQ ID NO: 494637 - DNA, 15 bp, Homo sapiens
attgggaaagtgggt

SEQ ID NO: 494638 - DNA, 15 bp, Homo sapiens
ttgggaaagtgggtg

SEQ ID NO: 494639 - DNA, 15 bp, Homo sapiens
tgggaaagtgggtgg

SEQ ID NO: 494640 - DNA, 15 bp, Homo sapiens
gggaaagtgggtggg

SEQ ID NO: 494641 - DNA, 15 bp, Homo sapiens
ggaaagtgggtgggg

SEQ ID NO: 494642 - DNA, 15 bp, Homo sapiens
gaaagtgggtggggg

SEQ ID NO: 494643 - DNA, 15 bp, Homo sapiens
aaagtgggtgggggc

SEQ ID NO: 494644 - DNA, 15 bp, Homo sapiens
aagtgggtgggggct

SEQ ID NO: 494645 - DNA, 15 bp, Homo sapiens
agtgggtgggggctt

SEQ ID NO: 494646 - DNA, 15 bp, Homo sapiens
gtgggtgggggcttt

SEQ ID NO: 494647 - DNA, 15 bp, Homo sapiens
tgggtgggggctttc

SEQ ID NO: 494648 - DNA, 15 bp, Homo sapiens
gggtgggggctttct

SEQ ID NO: 494649 - DNA, 15 bp, Homo sapiens
ggtgggggctttcta

SEQ ID NO: 494650 - DNA, 15 bp, Homo sapiens
gtgggggctttctaa

SEQ ID NO: 494651 - DNA, 15 bp, Homo sapiens
tgggggctttctaat

SEQ ID NO: 494652 - DNA, 15 bp, Homo sapiens
gggggctttctaata

SEQ ID NO: 494653 - DNA, 15 bp, Homo sapiens
ggggctttctaatat

SEQ ID NO: 494654 - DNA, 15 bp, Homo sapiens
gggctttctaatatg

SEQ ID NO: 494655 - DNA, 15 bp, Homo sapiens
ggctttctaatatga

SEQ ID NO: 494656 - DNA, 15 bp, Homo sapiens
gctttctaatatgat

SEQ ID NO: 494657 - DNA, 15 bp, Homo sapiens
ctttctaatatgata

SEQ ID NO: 494658 - DNA, 15 bp, Homo sapiens
tttctaatatgatac

SEQ ID NO: 494659 - DNA, 15 bp, Homo sapiens
ttctaatatgatacc

SEQ ID NO: 494660 - DNA, 15 bp, Homo sapiens
tctaatatgataccg

SEQ ID NO: 494661 - DNA, 15 bp, Homo sapiens
ctaatatgataccgt

SEQ ID NO: 494662 - DNA, 15 bp, Homo sapiens
taatatgataccgtc

SEQ ID NO: 494663 - DNA, 15 bp, Homo sapiens
aatatgataccgtct

SEQ ID NO: 494664 - DNA, 15 bp, Homo sapiens
atatgataccgtctt

SEQ ID NO: 494665 - DNA, 15 bp, Homo sapiens
tatgataccgtcttt

SEQ ID NO: 494666 - DNA, 15 bp, Homo sapiens
atgataccgtctttt

SEQ ID NO: 494667 - DNA, 15 bp, Homo sapiens
tgataccgtcttttt

SEQ ID NO: 494668 - DNA, 15 bp, Homo sapiens
gataccgtcttttta

SEQ ID NO: 494669 - DNA, 15 bp, Homo sapiens
ataccgtctttttaa

SEQ ID NO: 494670 - DNA, 15 bp, Homo sapiens
taccgtctttttaat

SEQ ID NO: 494671 - DNA, 15 bp, Homo sapiens
accgtctttttaata

SEQ ID NO: 494672 - DNA, 15 bp, Homo sapiens
ccgtctttttaataa

SEQ ID NO: 494673 - DNA, 15 bp, Homo sapiens
cgtctttttaataac

SEQ ID NO: 494674 - DNA, 15 bp, Homo sapiens
gtctttttaataact

SEQ ID NO: 494675 - DNA, 15 bp, Homo sapiens
tctttttaataacta

SEQ ID NO: 494676 - DNA, 15 bp, Homo sapiens
ctttttaataactat

SEQ ID NO: 494677 - DNA, 15 bp, Homo sapiens
tttttaataactatg

SEQ ID NO: 494678 - DNA, 15 bp, Homo sapiens
ttttaataactatga

SEQ ID NO: 494679 - DNA, 15 bp, Homo sapiens
tttaataactatgac

SEQ ID NO: 494680 - DNA, 15 bp, Homo sapiens
ttaataactatgaca

SEQ ID NO: 494681 - DNA, 15 bp, Homo sapiens
taataactatgacaa

SEQ ID NO: 494682 - DNA, 15 bp, Homo sapiens
aataactatgacaaa

SEQ ID NO: 494683 - DNA, 15 bp, Homo sapiens
ataactatgacaaag

SEQ ID NO: 494684 - DNA, 15 bp, Homo sapiens
taactatgacaaagc

SEQ ID NO: 494685 - DNA, 15 bp, Homo sapiens
aactatgacaaagct

SEQ ID NO: 494686 - DNA, 15 bp, Homo sapiens
actatgacaaagctt

SEQ ID NO: 494687 - DNA, 15 bp, Homo sapiens
ctatgacaaagctta

SEQ ID NO: 494688 - DNA, 15 bp, Homo sapiens
tatgacaaagcttac

SEQ ID NO: 494689 - DNA, 15 bp, Homo sapiens
atgacaaagcttaca

SEQ ID NO: 494690 - DNA, 15 bp, Homo sapiens
tgacaaagcttacat

SEQ ID NO: 494691 - DNA, 15 bp, Homo sapiens
gacaaagcttacata

SEQ ID NO: 494692 - DNA, 15 bp, Homo sapiens
acaaagcttacataa

SEQ ID NO: 494693 - DNA, 15 bp, Homo sapiens
caaagcttacataag

SEQ ID NO: 494694 - DNA, 15 bp, Homo sapiens
aaagcttacataaga

SEQ ID NO: 494695 - DNA, 15 bp, Homo sapiens
aagcttacataagaa

SEQ ID NO: 494696 - DNA, 15 bp, Homo sapiens
agcttacataagaat

SEQ ID NO: 494697 - DNA, 15 bp, Homo sapiens
gcttacataagaatt

SEQ ID NO: 494698 - DNA, 15 bp, Homo sapiens
cttacataagaatta

SEQ ID NO: 494699 - DNA, 15 bp, Homo sapiens
ttacataagaattag

SEQ ID NO: 494700 - DNA, 15 bp, Homo sapiens
tacataagaattaga

SEQ ID NO: 494701 - DNA, 15 bp, Homo sapiens
acataagaattagaa

SEQ ID NO: 494702 - DNA, 15 bp, Homo sapiens
cataagaattagaag

SEQ ID NO: 494703 - DNA, 15 bp, Homo sapiens
ataagaattagaaga

SEQ ID NO: 494704 - DNA, 15 bp, Homo sapiens
taagaattagaagac

SEQ ID NO: 494705 - DNA, 15 bp, Homo sapiens
aagaattagaagacc

SEQ ID NO: 494706 - DNA, 15 bp, Homo sapiens
agaattagaagacca

SEQ ID NO: 494707 - DNA, 15 bp, Homo sapiens
gaattagaagaccac

SEQ ID NO: 494708 - DNA, 15 bp, Homo sapiens
aattagaagaccact

SEQ ID NO: 494709 - DNA, 15 bp, Homo sapiens
attagaagaccactt

SEQ ID NO: 494710 - DNA, 15 bp, Homo sapiens
ttagaagaccacttt

SEQ ID NO: 494711 - DNA, 15 bp, Homo sapiens
tagaagaccacttta

SEQ ID NO: 494712 - DNA, 15 bp, Homo sapiens
agaagaccactttac

SEQ ID NO: 494713 - DNA, 15 bp, Homo sapiens
gaagaccactttaca

SEQ ID NO: 494714 - DNA, 15 bp, Homo sapiens
aagaccactttacat

SEQ ID NO: 494715 - DNA, 15 bp, Homo sapiens
agaccactttacatt

SEQ ID NO: 494716 - DNA, 15 bp, Homo sapiens
gaccactttacattt

SEQ ID NO: 494717 - DNA, 15 bp, Homo sapiens
accactttacatttt

SEQ ID NO: 494718 - DNA, 15 bp, Homo sapiens
ccactttacattttt

SEQ ID NO: 494719 - DNA, 15 bp, Homo sapiens
cactttacattttta

SEQ ID NO: 494720 - DNA, 15 bp, Homo sapiens
actttacatttttac

SEQ ID NO: 494721 - DNA, 15 bp, Homo sapiens
ctttacatttttaca

SEQ ID NO: 494722 - DNA, 15 bp, Homo sapiens
tttacatttttacat

SEQ ID NO: 494723 - DNA, 15 bp, Homo sapiens
ttacatttttacatt

SEQ ID NO: 494724 - DNA, 15 bp, Homo sapiens
tacatttttacattc

SEQ ID NO: 494725 - DNA, 15 bp, Homo sapiens
acatttttacattcc

SEQ ID NO: 494726 - DNA, 15 bp, Homo sapiens
catttttacattcct

SEQ ID NO: 494727 - DNA, 15 bp, Homo sapiens
atttttacattcctt

SEQ ID NO: 494728 - DNA, 15 bp, Homo sapiens
tttttacattccttc

SEQ ID NO: 494729 - DNA, 15 bp, Homo sapiens
ttttacattccttct

SEQ ID NO: 494730 - DNA, 15 bp, Homo sapiens
tttacattccttctg

SEQ ID NO: 494731 - DNA, 15 bp, Homo sapiens
ttacattccttctgc

SEQ ID NO: 494732 - DNA, 15 bp, Homo sapiens
tacattccttctgct

SEQ ID NO: 494733 - DNA, 15 bp, Homo sapiens
acattccttctgctg

SEQ ID NO: 494734 - DNA, 15 bp, Homo sapiens
cattccttctgctgt

SEQ ID NO: 494735 - DNA, 15 bp, Homo sapiens
attccttctgctgtt

SEQ ID NO: 494736 - DNA, 15 bp, Homo sapiens
ttccttctgctgttc

SEQ ID NO: 494737 - DNA, 15 bp, Homo sapiens
tccttctgctgttca

SEQ ID NO: 494738 - DNA, 15 bp, Homo sapiens
ccttctgctgttcat

SEQ ID NO: 494739 - DNA, 15 bp, Homo sapiens
cttctgctgttcata

SEQ ID NO: 494740 - DNA, 15 bp, Homo sapiens
ttctgctgttcatat

SEQ ID NO: 494741 - DNA, 15 bp, Homo sapiens
tctgctgttcatatt

SEQ ID NO: 494742 - DNA, 15 bp, Homo sapiens
ctgctgttcatatta

SEQ ID NO: 494743 - DNA, 15 bp, Homo sapiens
tgctgttcatattaa

SEQ ID NO: 494744 - DNA, 15 bp, Homo sapiens
gctgttcatattaac

SEQ ID NO: 494745 - DNA, 15 bp, Homo sapiens
ctgttcatattaacc

SEQ ID NO: 494746 - DNA, 15 bp, Homo sapiens
tgttcatattaacct

SEQ ID NO: 494747 - DNA, 15 bp, Homo sapiens
gttcatattaacctt

SEQ ID NO: 494748 - DNA, 15 bp, Homo sapiens
ttcatattaaccttg

SEQ ID NO: 494749 - DNA, 15 bp, Homo sapiens
tcatattaaccttgc

SEQ ID NO: 494750 - DNA, 15 bp, Homo sapiens
catattaaccttgca

SEQ ID NO: 494751 - DNA, 15 bp, Homo sapiens
atattaaccttgcac

SEQ ID NO: 494752 - DNA, 15 bp, Homo sapiens
tattaaccttgcaca

SEQ ID NO: 494753 - DNA, 15 bp, Homo sapiens
attaaccttgcacaa

SEQ ID NO: 494754 - DNA, 15 bp, Homo sapiens
ttaaccttgcacaat

SEQ ID NO: 494755 - DNA, 15 bp, Homo sapiens
taaccttgcacaatt

SEQ ID NO: 494756 - DNA, 15 bp, Homo sapiens
aaccttgcacaatta

SEQ ID NO: 494757 - DNA, 15 bp, Homo sapiens
accttgcacaattac

SEQ ID NO: 494758 - DNA, 15 bp, Homo sapiens
ccttgcacaattact

SEQ ID NO: 494759 - DNA, 15 bp, Homo sapiens
cttgcacaattactt

SEQ ID NO: 494760 - DNA, 15 bp, Homo sapiens
ttgcacaattacttc

SEQ ID NO: 494761 - DNA, 15 bp, Homo sapiens
tgcacaattacttca

SEQ ID NO: 494762 - DNA, 15 bp, Homo sapiens
gcacaattacttcat

SEQ ID NO: 494763 - DNA, 15 bp, Homo sapiens
cacaattacttcatt

SEQ ID NO: 494764 - DNA, 15 bp, Homo sapiens
acaattacttcattt

SEQ ID NO: 494765 - DNA, 15 bp, Homo sapiens
caattacttcatttt

SEQ ID NO: 494766 - DNA, 15 bp, Homo sapiens
aattacttcattttt

SEQ ID NO: 494767 - DNA, 15 bp, Homo sapiens
attacttcatttttt

SEQ ID NO: 494768 - DNA, 15 bp, Homo sapiens
ttacttcattttttc

SEQ ID NO: 494769 - DNA, 15 bp, Homo sapiens
tacttcattttttct

SEQ ID NO: 494770 - DNA, 15 bp, Homo sapiens
acttcattttttctt

SEQ ID NO: 494771 - DNA, 15 bp, Homo sapiens
cttcattttttcttt

SEQ ID NO: 494772 - DNA, 15 bp, Homo sapiens
ttcattttttctttg

SEQ ID NO: 494773 - DNA, 15 bp, Homo sapiens
tcattttttctttga

SEQ ID NO: 494774 - DNA, 15 bp, Homo sapiens
cattttttctttgac

SEQ ID NO: 494775 - DNA, 15 bp, Homo sapiens
attttttctttgact

SEQ ID NO: 494776 - DNA, 15 bp, Homo sapiens
ttttttctttgactc

SEQ ID NO: 494777 - DNA, 15 bp, Homo sapiens
tttttctttgactct

SEQ ID NO: 494778 - DNA, 15 bp, Homo sapiens
ttttctttgactctt

SEQ ID NO: 494779 - DNA, 15 bp, Homo sapiens
tttctttgactcttt

SEQ ID NO: 494780 - DNA, 15 bp, Homo sapiens
ttctttgactctttt

SEQ ID NO: 494781 - DNA, 15 bp, Homo sapiens
tctttgactctttta

SEQ ID NO: 494782 - DNA, 15 bp, Homo sapiens
ctttgactcttttac

SEQ ID NO: 494783 - DNA, 15 bp, Homo sapiens
tttgactcttttacc

SEQ ID NO: 494784 - DNA, 15 bp, Homo sapiens
ttgactcttttacca

SEQ ID NO: 494785 - DNA, 15 bp, Homo sapiens
tgactcttttaccac

SEQ ID NO: 494786 - DNA, 15 bp, Homo sapiens
gactcttttaccaca

SEQ ID NO: 494787 - DNA, 15 bp, Homo sapiens
actcttttaccacaa

SEQ ID NO: 494788 - DNA, 15 bp, Homo sapiens
ctcttttaccacaat

SEQ ID NO: 494789 - DNA, 15 bp, Homo sapiens
tcttttaccacaatg

SEQ ID NO: 494790 - DNA, 15 bp, Homo sapiens
cttttaccacaatgt

SEQ ID NO: 494791 - DNA, 15 bp, Homo sapiens
ttttaccacaatgtt

SEQ ID NO: 494792 - DNA, 15 bp, Homo sapiens
tttaccacaatgttt

SEQ ID NO: 494793 - DNA, 15 bp, Homo sapiens
ttaccacaatgtttt

SEQ ID NO: 494794 - DNA, 15 bp, Homo sapiens
taccacaatgttttg

SEQ ID NO: 494795 - DNA, 15 bp, Homo sapiens
accacaatgttttgg

SEQ ID NO: 494796 - DNA, 15 bp, Homo sapiens
ccacaatgttttggt

SEQ ID NO: 494797 - DNA, 15 bp, Homo sapiens
cacaatgttttggtt

SEQ ID NO: 494798 - DNA, 15 bp, Homo sapiens
acaatgttttggtta

SEQ ID NO: 494799 - DNA, 15 bp, Homo sapiens
caatgttttggttat

SEQ ID NO: 494800 - DNA, 15 bp, Homo sapiens
aatgttttggttatt

SEQ ID NO: 494801 - DNA, 15 bp, Homo sapiens
gttttggttatttat

SEQ ID NO: 494802 - DNA, 15 bp, Homo sapiens
ttttggttatttata

SEQ ID NO: 494803 - DNA, 15 bp, Homo sapiens
tttggttatttataa

SEQ ID NO: 494804 - DNA, 15 bp, Homo sapiens
ttggttatttataat

SEQ ID NO: 494805 - DNA, 15 bp, Homo sapiens
tggttatttataatt

SEQ ID NO: 494806 - DNA, 15 bp, Homo sapiens
ggttatttataattt

SEQ ID NO: 494807 - DNA, 15 bp, Homo sapiens
gttatttataattta

SEQ ID NO: 494808 - DNA, 15 bp, Homo sapiens
tatttataatttatc

SEQ ID NO: 494809 - DNA, 15 bp, Homo sapiens
atttataatttatca

SEQ ID NO: 494810 - DNA, 15 bp, Homo sapiens
tttataatttatcag

SEQ ID NO: 494811 - DNA, 15 bp, Homo sapiens
ttataatttatcagc

SEQ ID NO: 494812 - DNA, 15 bp, Homo sapiens
tataatttatcagcc

SEQ ID NO: 494813 - DNA, 15 bp, Homo sapiens
ataatttatcagcca

SEQ ID NO: 494814 - DNA, 15 bp, Homo sapiens
taatttatcagccat

SEQ ID NO: 494815 - DNA, 15 bp, Homo sapiens
aatttatcagccata

SEQ ID NO: 494816 - DNA, 15 bp, Homo sapiens
atttatcagccatat

SEQ ID NO: 494817 - DNA, 15 bp, Homo sapiens
tttatcagccatatg

SEQ ID NO: 494818 - DNA, 15 bp, Homo sapiens
ttatcagccatatgt

SEQ ID NO: 494819 - DNA, 15 bp, Homo sapiens
tatcagccatatgtt

SEQ ID NO: 494820 - DNA, 15 bp, Homo sapiens
atcagccatatgttt

SEQ ID NO: 494821 - DNA, 15 bp, Homo sapiens
tcagccatatgttta

SEQ ID NO: 494822 - DNA, 15 bp, Homo sapiens
cagccatatgtttat

SEQ ID NO: 494823 - DNA, 15 bp, Homo sapiens
agccatatgtttatc

SEQ ID NO: 494824 - DNA, 15 bp, Homo sapiens
gccatatgtttatca

SEQ ID NO: 494825 - DNA, 15 bp, Homo sapiens
ccatatgtttatcag

SEQ ID NO: 494826 - DNA, 15 bp, Homo sapiens
catatgtttatcagc

SEQ ID NO: 494827 - DNA, 15 bp, Homo sapiens
atatgtttatcagcc

SEQ ID NO: 494828 - DNA, 15 bp, Homo sapiens
tatgtttatcagcca

SEQ ID NO: 494829 - DNA, 15 bp, Homo sapiens
atgtttatcagccat

SEQ ID NO: 494830 - DNA, 15 bp, Homo sapiens
tgtttatcagccata

SEQ ID NO: 494831 - DNA, 15 bp, Homo sapiens
gtttatcagccatat

SEQ ID NO: 494832 - DNA, 15 bp, Homo sapiens
tttatcagccatata

SEQ ID NO: 494833 - DNA, 15 bp, Homo sapiens
ttatcagccatataa

SEQ ID NO: 494834 - DNA, 15 bp, Homo sapiens
tatcagccatataac

SEQ ID NO: 494835 - DNA, 15 bp, Homo sapiens
atcagccatataacc

SEQ ID NO: 494836 - DNA, 15 bp, Homo sapiens
tcagccatataacca

SEQ ID NO: 494837 - DNA, 15 bp, Homo sapiens
cagccatataaccaa

SEQ ID NO: 494838 - DNA, 15 bp, Homo sapiens
agccatataaccaac

SEQ ID NO: 494839 - DNA, 15 bp, Homo sapiens
gccatataaccaact

SEQ ID NO: 494840 - DNA, 15 bp, Homo sapiens
ccatataaccaacta

SEQ ID NO: 494841 - DNA, 15 bp, Homo sapiens
catataaccaactag

SEQ ID NO: 494842 - DNA, 15 bp, Homo sapiens
atataaccaactaga

SEQ ID NO: 494843 - DNA, 15 bp, Homo sapiens
tataaccaactagat

SEQ ID NO: 494844 - DNA, 15 bp, Homo sapiens
ataaccaactagatc

SEQ ID NO: 494845 - DNA, 15 bp, Homo sapiens
taaccaactagatcc

SEQ ID NO: 494846 - DNA, 15 bp, Homo sapiens
aaccaactagatccc

SEQ ID NO: 494847 - DNA, 15 bp, Homo sapiens
accaactagatccca

SEQ ID NO: 494848 - DNA, 15 bp, Homo sapiens
ccaactagatcccaa

SEQ ID NO: 494849 - DNA, 15 bp, Homo sapiens
caactagatcccaaa

SEQ ID NO: 494850 - DNA, 15 bp, Homo sapiens
aactagatcccaaat

SEQ ID NO: 494851 - DNA, 15 bp, Homo sapiens
actagatcccaaata

SEQ ID NO: 494852 - DNA, 15 bp, Homo sapiens
ctagatcccaaatag

SEQ ID NO: 494853 - DNA, 15 bp, Homo sapiens
tagatcccaaataga

SEQ ID NO: 494854 - DNA, 15 bp, Homo sapiens
agatcccaaatagat

SEQ ID NO: 494855 - DNA, 15 bp, Homo sapiens
gatcccaaatagatc

SEQ ID NO: 494856 - DNA, 15 bp, Homo sapiens
atcccaaatagatcc

SEQ ID NO: 494857 - DNA, 15 bp, Homo sapiens
tcccaaatagatcca

SEQ ID NO: 494858 - DNA, 15 bp, Homo sapiens
cccaaatagatccat

SEQ ID NO: 494859 - DNA, 15 bp, Homo sapiens
ccaaatagatccatg

SEQ ID NO: 494860 - DNA, 15 bp, Homo sapiens
caaatagatccatgt

SEQ ID NO: 494861 - DNA, 15 bp, Homo sapiens
aaatagatccatgta

SEQ ID NO: 494862 - DNA, 15 bp, Homo sapiens
aatagatccatgtat

SEQ ID NO: 494863 - DNA, 15 bp, Homo sapiens
atagatccatgtatt

SEQ ID NO: 494864 - DNA, 15 bp, Homo sapiens
tagatccatgtattt

SEQ ID NO: 494865 - DNA, 15 bp, Homo sapiens
agatccatgtatttg

SEQ ID NO: 494866 - DNA, 15 bp, Homo sapiens
gatccatgtatttgt

SEQ ID NO: 494867 - DNA, 15 bp, Homo sapiens
atccatgtatttgtt

SEQ ID NO: 494868 - DNA, 15 bp, Homo sapiens
ccatgtatttgtttc

SEQ ID NO: 494869 - DNA, 15 bp, Homo sapiens
catgtatttgtttcc

SEQ ID NO: 494870 - DNA, 15 bp, Homo sapiens
atgtatttgtttccg

SEQ ID NO: 494871 - DNA, 15 bp, Homo sapiens
tgtatttgtttccgt

SEQ ID NO: 494872 - DNA, 15 bp, Homo sapiens
gtatttgtttccgtg

SEQ ID NO: 494873 - DNA, 15 bp, Homo sapiens
tatttgtttccgtga

SEQ ID NO: 494874 - DNA, 15 bp, Homo sapiens
atttgtttccgtgat

SEQ ID NO: 494875 - DNA, 15 bp, Homo sapiens
tttgtttccgtgatt

SEQ ID NO: 494876 - DNA, 15 bp, Homo sapiens
ttgtttccgtgattt

SEQ ID NO: 494877 - DNA, 15 bp, Homo sapiens
tgtttccgtgatttg

SEQ ID NO: 494878 - DNA, 15 bp, Homo sapiens
gtttccgtgatttgg

SEQ ID NO: 494879 - DNA, 15 bp, Homo sapiens
tttccgtgatttggc

SEQ ID NO: 494880 - DNA, 15 bp, Homo sapiens
ttccgtgatttggcc

SEQ ID NO: 494881 - DNA, 15 bp, Homo sapiens
tccgtgatttggcca

SEQ ID NO: 494882 - DNA, 15 bp, Homo sapiens
ccgtgatttggccac

SEQ ID NO: 494883 - DNA, 15 bp, Homo sapiens
cgtgatttggccaca

SEQ ID NO: 494884 - DNA, 15 bp, Homo sapiens
gtgatttggccacat

SEQ ID NO: 494885 - DNA, 15 bp, Homo sapiens
tgatttggccacatt

SEQ ID NO: 494886 - DNA, 15 bp, Homo sapiens
gatttggccacatta

SEQ ID NO: 494887 - DNA, 15 bp, Homo sapiens
atttggccacattaa

SEQ ID NO: 494888 - DNA, 15 bp, Homo sapiens
tttggccacattaat

SEQ ID NO: 494889 - DNA, 15 bp, Homo sapiens
ttggccacattaata

SEQ ID NO: 494890 - DNA, 15 bp, Homo sapiens
tggccacattaataa

SEQ ID NO: 494891 - DNA, 15 bp, Homo sapiens
ggccacattaataaa

SEQ ID NO: 494892 - DNA, 15 bp, Homo sapiens
gccacattaataaat

SEQ ID NO: 494893 - DNA, 15 bp, Homo sapiens
ccacattaataaatt

SEQ ID NO: 494894 - DNA, 15 bp, Homo sapiens
cacattaataaattc

SEQ ID NO: 494895 - DNA, 15 bp, Homo sapiens
acattaataaattca

SEQ ID NO: 494896 - DNA, 15 bp, Homo sapiens
cattaataaattcat

SEQ ID NO: 494897 - DNA, 15 bp, Homo sapiens
attaataaattcata

SEQ ID NO: 494898 - DNA, 15 bp, Homo sapiens
ttaataaattcataa

SEQ ID NO: 494899 - DNA, 15 bp, Homo sapiens
taataaattcataaa

SEQ ID NO: 494900 - DNA, 15 bp, Homo sapiens
aataaattcataaat

SEQ ID NO: 494901 - DNA, 15 bp, Homo sapiens
ataaattcataaatt

SEQ ID NO: 494902 - DNA, 15 bp, Homo sapiens
taaattcataaattt

SEQ ID NO: 494903 - DNA, 15 bp, Homo sapiens
aaattcataaatttc

SEQ ID NO: 494904 - DNA, 15 bp, Homo sapiens
aattcataaatttca

SEQ ID NO: 494905 - DNA, 15 bp, Homo sapiens
attcataaatttcaa

SEQ ID NO: 494906 - DNA, 15 bp, Homo sapiens
ttcataaatttcaat

SEQ ID NO: 494907 - DNA, 15 bp, Homo sapiens
tcataaatttcaatc

SEQ ID NO: 494908 - DNA, 15 bp, Homo sapiens
cataaatttcaatca

SEQ ID NO: 494909 - DNA, 15 bp, Homo sapiens
ataaatttcaatcaa

SEQ ID NO: 494910 - DNA, 15 bp, Homo sapiens
taaatttcaatcaaa

SEQ ID NO: 494911 - DNA, 15 bp, Homo sapiens
aaatttcaatcaaat

SEQ ID NO: 494912 - DNA, 15 bp, Homo sapiens
aatttcaatcaaata

SEQ ID NO: 494913 - DNA, 15 bp, Homo sapiens
atttcaatcaaatat

SEQ ID NO: 494914 - DNA, 15 bp, Homo sapiens
tttcaatcaaatatc

SEQ ID NO: 494915 - DNA, 15 bp, Homo sapiens
ttcaatcaaatatct

SEQ ID NO: 494916 - DNA, 15 bp, Homo sapiens
tcaatcaaatatctt

SEQ ID NO: 494917 - DNA, 15 bp, Homo sapiens
caatcaaatatctta

SEQ ID NO: 494918 - DNA, 15 bp, Homo sapiens
aatcaaatatcttat

SEQ ID NO: 494919 - DNA, 15 bp, Homo sapiens
atcaaatatcttata

SEQ ID NO: 494920 - DNA, 15 bp, Homo sapiens
tcaaatatcttatat

SEQ ID NO: 494921 - DNA, 15 bp, Homo sapiens
caaatatcttatata

SEQ ID NO: 494922 - DNA, 15 bp, Homo sapiens
aaatatcttatatat

SEQ ID NO: 494923 - DNA, 15 bp, Homo sapiens
aatatcttatatata

SEQ ID NO: 494924 - DNA, 15 bp, Homo sapiens
atatcttatatatac

SEQ ID NO: 494925 - DNA, 15 bp, Homo sapiens
tatcttatatataca

SEQ ID NO: 494926 - DNA, 15 bp, Homo sapiens
atcttatatatacac

SEQ ID NO: 494927 - DNA, 15 bp, Homo sapiens
tcttatatatacaca

SEQ ID NO: 494928 - DNA, 15 bp, Homo sapiens
cttatatatacacac

SEQ ID NO: 494929 - DNA, 15 bp, Homo sapiens
ttatatatacacaca

SEQ ID NO: 494930 - DNA, 15 bp, Homo sapiens
atatacacacatatg

SEQ ID NO: 494931 - DNA, 15 bp, Homo sapiens
tatacacacatatgg

SEQ ID NO: 494932 - DNA, 15 bp, Homo sapiens
atacacacatatggt

SEQ ID NO: 494933 - DNA, 15 bp, Homo sapiens
tacacacatatggtt

SEQ ID NO: 494934 - DNA, 15 bp, Homo sapiens
acacacatatggttt

SEQ ID NO: 494935 - DNA, 15 bp, Homo sapiens
cacacatatggttta

SEQ ID NO: 494936 - DNA, 15 bp, Homo sapiens
acacatatggtttaa

SEQ ID NO: 494937 - DNA, 15 bp, Homo sapiens
cacatatggtttaag

SEQ ID NO: 494938 - DNA, 15 bp, Homo sapiens
acatatggtttaagc

SEQ ID NO: 494939 - DNA, 15 bp, Homo sapiens
catatggtttaagct

SEQ ID NO: 494940 - DNA, 15 bp, Homo sapiens
atatggtttaagcta

SEQ ID NO: 494941 - DNA, 15 bp, Homo sapiens
tatggtttaagctac

SEQ ID NO: 494942 - DNA, 15 bp, Homo sapiens
atggtttaagctaca

SEQ ID NO: 494943 - DNA, 15 bp, Homo sapiens
tggtttaagctacag

SEQ ID NO: 494944 - DNA, 15 bp, Homo sapiens
ggtttaagctacagc

SEQ ID NO: 494945 - DNA, 15 bp, Homo sapiens
gtttaagctacagcc

SEQ ID NO: 494946 - DNA, 15 bp, Homo sapiens
tttaagctacagccc

SEQ ID NO: 494947 - DNA, 15 bp, Homo sapiens
ttaagctacagccct

SEQ ID NO: 494948 - DNA, 15 bp, Homo sapiens
taagctacagccctg

SEQ ID NO: 494949 - DNA, 15 bp, Homo sapiens
aagctacagccctgt

SEQ ID NO: 494950 - DNA, 15 bp, Homo sapiens
agctacagccctgtg

SEQ ID NO: 494951 - DNA, 15 bp, Homo sapiens
gctacagccctgtgt

SEQ ID NO: 494952 - DNA, 15 bp, Homo sapiens
ctacagccctgtgta

SEQ ID NO: 494953 - DNA, 15 bp, Homo sapiens
tacagccctgtgtat

SEQ ID NO: 494954 - DNA, 15 bp, Homo sapiens
acagccctgtgtatg

SEQ ID NO: 494955 - DNA, 15 bp, Homo sapiens
cagccctgtgtatgc

SEQ ID NO: 494956 - DNA, 15 bp, Homo sapiens
agccctgtgtatgcc

SEQ ID NO: 494957 - DNA, 15 bp, Homo sapiens
gccctgtgtatgccg

SEQ ID NO: 494958 - DNA, 15 bp, Homo sapiens
ccctgtgtatgccgt

SEQ ID NO: 494959 - DNA, 15 bp, Homo sapiens
cctgtgtatgccgtt

SEQ ID NO: 494960 - DNA, 15 bp, Homo sapiens
ctgtgtatgccgttt

SEQ ID NO: 494961 - DNA, 15 bp, Homo sapiens
tgtgtatgccgttta

SEQ ID NO: 494962 - DNA, 15 bp, Homo sapiens
gtgtatgccgtttaa

SEQ ID NO: 494963 - DNA, 15 bp, Homo sapiens
tgtatgccgtttaac

SEQ ID NO: 494964 - DNA, 15 bp, Homo sapiens
gtatgccgtttaact

SEQ ID NO: 494965 - DNA, 15 bp, Homo sapiens
tatgccgtttaactt

SEQ ID NO: 494966 - DNA, 15 bp, Homo sapiens
atgccgtttaacttt

SEQ ID NO: 494967 - DNA, 15 bp, Homo sapiens
tgccgtttaacttta

SEQ ID NO: 494968 - DNA, 15 bp, Homo sapiens
gccgtttaactttat

SEQ ID NO: 494969 - DNA, 15 bp, Homo sapiens
ccgtttaactttatt

SEQ ID NO: 494970 - DNA, 15 bp, Homo sapiens
cgtttaactttattt

SEQ ID NO: 494971 - DNA, 15 bp, Homo sapiens
gtttaactttatttg

SEQ ID NO: 494972 - DNA, 15 bp, Homo sapiens
tttaactttatttga

SEQ ID NO: 494973 - DNA, 15 bp, Homo sapiens
ttaactttatttgac

SEQ ID NO: 494974 - DNA, 15 bp, Homo sapiens
taactttatttgacg

SEQ ID NO: 494975 - DNA, 15 bp, Homo sapiens
aactttatttgacgt

SEQ ID NO: 494976 - DNA, 15 bp, Homo sapiens
actttatttgacgtt

SEQ ID NO: 494977 - DNA, 15 bp, Homo sapiens
ctttatttgacgttg

SEQ ID NO: 494978 - DNA, 15 bp, Homo sapiens
tttatttgacgttgc

SEQ ID NO: 494979 - DNA, 15 bp, Homo sapiens
ttatttgacgttgcc

SEQ ID NO: 494980 - DNA, 15 bp, Homo sapiens
tatttgacgttgccc

SEQ ID NO: 494981 - DNA, 15 bp, Homo sapiens
atttgacgttgccca

SEQ ID NO: 494982 - DNA, 15 bp, Homo sapiens
tttgacgttgcccac

SEQ ID NO: 494983 - DNA, 15 bp, Homo sapiens
ttgacgttgcccact

SEQ ID NO: 494984 - DNA, 15 bp, Homo sapiens
tgacgttgcccactt

SEQ ID NO: 494985 - DNA, 15 bp, Homo sapiens
gacgttgcccactta

SEQ ID NO: 494986 - DNA, 15 bp, Homo sapiens
acgttgcccacttac

SEQ ID NO: 494987 - DNA, 15 bp, Homo sapiens
cgttgcccacttact

SEQ ID NO: 494988 - DNA, 15 bp, Homo sapiens
gttgcccacttactt

SEQ ID NO: 494989 - DNA, 15 bp, Homo sapiens
ttgcccacttacttc

SEQ ID NO: 494990 - DNA, 15 bp, Homo sapiens
tgcccacttacttct

SEQ ID NO: 494991 - DNA, 15 bp, Homo sapiens
gcccacttacttctt

SEQ ID NO: 494992 - DNA, 15 bp, Homo sapiens
cccacttacttcttt

SEQ ID NO: 494993 - DNA, 15 bp, Homo sapiens
ccacttacttctttg

SEQ ID NO: 494994 - DNA, 15 bp, Homo sapiens
cacttacttctttgc

SEQ ID NO: 494995 - DNA, 15 bp, Homo sapiens
acttacttctttgct

SEQ ID NO: 494996 - DNA, 15 bp, Homo sapiens
cttacttctttgctg

SEQ ID NO: 494997 - DNA, 15 bp, Homo sapiens
ttacttctttgctga

SEQ ID NO: 494998 - DNA, 15 bp, Homo sapiens
tacttctttgctgac

SEQ ID NO: 494999 - DNA, 15 bp, Homo sapiens
acttctttgctgacc

SEQ ID NO: 495000 - DNA, 15 bp, Homo sapiens
cttctttgctgacca

SEQ ID NO: 495001 - DNA, 15 bp, Homo sapiens
ttctttgctgaccac

SEQ ID NO: 495002 - DNA, 15 bp, Homo sapiens
tctttgctgaccact

SEQ ID NO: 495003 - DNA, 15 bp, Homo sapiens
ctttgctgaccactt

SEQ ID NO: 495004 - DNA, 15 bp, Homo sapiens
tttgctgaccacttg

SEQ ID NO: 495005 - DNA, 15 bp, Homo sapiens
ttgctgaccacttgg

SEQ ID NO: 495006 - DNA, 15 bp, Homo sapiens
tgctgaccacttgga

SEQ ID NO: 495007 - DNA, 15 bp, Homo sapiens
gctgaccacttggat

SEQ ID NO: 495008 - DNA, 15 bp, Homo sapiens
ctgaccacttggata

SEQ ID NO: 495009 - DNA, 15 bp, Homo sapiens
tgaccacttggataa

SEQ ID NO: 495010 - DNA, 15 bp, Homo sapiens
gaccacttggataac

SEQ ID NO: 495011 - DNA, 15 bp, Homo sapiens
accacttggataacc

SEQ ID NO: 495012 - DNA, 15 bp, Homo sapiens
ccacttggataaccg

SEQ ID NO: 495013 - DNA, 15 bp, Homo sapiens
cacttggataaccgt

SEQ ID NO: 495014 - DNA, 15 bp, Homo sapiens
acttggataaccgta

SEQ ID NO: 495015 - DNA, 15 bp, Homo sapiens
cttggataaccgtaa

SEQ ID NO: 495016 - DNA, 15 bp, Homo sapiens
ttggataaccgtaat

SEQ ID NO: 495017 - DNA, 15 bp, Homo sapiens
tggataaccgtaata

SEQ ID NO: 495018 - DNA, 15 bp, Homo sapiens
ggataaccgtaataa

SEQ ID NO: 495019 - DNA, 15 bp, Homo sapiens
gataaccgtaataaa

SEQ ID NO: 495020 - DNA, 15 bp, Homo sapiens
ataaccgtaataaaa

SEQ ID NO: 495021 - DNA, 15 bp, Homo sapiens
taaccgtaataaaaa

SEQ ID NO: 495022 - DNA, 15 bp, Homo sapiens
aaccgtaataaaaat

SEQ ID NO: 495023 - DNA, 15 bp, Homo sapiens
accgtaataaaaatc

SEQ ID NO: 495024 - DNA, 15 bp, Homo sapiens
ccgtaataaaaatcc

SEQ ID NO: 495025 - DNA, 15 bp, Homo sapiens
cgtaataaaaatcct

SEQ ID NO: 495026 - DNA, 15 bp, Homo sapiens
gtaataaaaatccta

SEQ ID NO: 495027 - DNA, 15 bp, Homo sapiens
taataaaaatcctat

SEQ ID NO: 495028 - DNA, 15 bp, Homo sapiens
aataaaaatcctata

SEQ ID NO: 495029 - DNA, 15 bp, Homo sapiens
ataaaaatcctataa

SEQ ID NO: 495030 - DNA, 15 bp, Homo sapiens
taaaaatcctataag

SEQ ID NO: 495031 - DNA, 15 bp, Homo sapiens
aaaaatcctataagc

SEQ ID NO: 495032 - DNA, 15 bp, Homo sapiens
aaaatcctataagcc

SEQ ID NO: 495033 - DNA, 15 bp, Homo sapiens
aaatcctataagcct

SEQ ID NO: 495034 - DNA, 15 bp, Homo sapiens
aatcctataagccta

SEQ ID NO: 495035 - DNA, 15 bp, Homo sapiens
atcctataagcctaa

SEQ ID NO: 495036 - DNA, 15 bp, Homo sapiens
tcctataagcctaaa

SEQ ID NO: 495037 - DNA, 15 bp, Homo sapiens
cctataagcctaaat

SEQ ID NO: 495038 - DNA, 15 bp, Homo sapiens
ctataagcctaaatg

SEQ ID NO: 495039 - DNA, 15 bp, Homo sapiens
tataagcctaaatgg

SEQ ID NO: 495040 - DNA, 15 bp, Homo sapiens
ataagcctaaatggc

SEQ ID NO: 495041 - DNA, 15 bp, Homo sapiens
taagcctaaatggca

SEQ ID NO: 495042 - DNA, 15 bp, Homo sapiens
aagcctaaatggcat

SEQ ID NO: 495043 - DNA, 15 bp, Homo sapiens
agcctaaatggcatt

SEQ ID NO: 495044 - DNA, 15 bp, Homo sapiens
gcctaaatggcattt

SEQ ID NO: 495045 - DNA, 15 bp, Homo sapiens
cctaaatggcatttc

SEQ ID NO: 495046 - DNA, 15 bp, Homo sapiens
ctaaatggcatttct

SEQ ID NO: 495047 - DNA, 15 bp, Homo sapiens
taaatggcatttctt

SEQ ID NO: 495048 - DNA, 15 bp, Homo sapiens
aaatggcatttcttt

SEQ ID NO: 495049 - DNA, 15 bp, Homo sapiens
aatggcatttctttt

SEQ ID NO: 495050 - DNA, 15 bp, Homo sapiens
atggcatttcttttg

SEQ ID NO: 495051 - DNA, 15 bp, Homo sapiens
tggcatttcttttgg

SEQ ID NO: 495052 - DNA, 15 bp, Homo sapiens
ggcatttcttttggg

SEQ ID NO: 495053 - DNA, 15 bp, Homo sapiens
gcatttcttttggga

SEQ ID NO: 495054 - DNA, 15 bp, Homo sapiens
catttcttttgggat

SEQ ID NO: 495055 - DNA, 15 bp, Homo sapiens
atttcttttgggata

SEQ ID NO: 495056 - DNA, 15 bp, Homo sapiens
tttcttttgggatat

SEQ ID NO: 495057 - DNA, 15 bp, Homo sapiens
ttcttttgggatatt

SEQ ID NO: 495058 - DNA, 15 bp, Homo sapiens
tcttttgggatattt

SEQ ID NO: 495059 - DNA, 15 bp, Homo sapiens
cttttgggatatttt

SEQ ID NO: 495060 - DNA, 15 bp, Homo sapiens
ttttgggatattttt

SEQ ID NO: 495061 - DNA, 15 bp, Homo sapiens
tttgggatatttttc

SEQ ID NO: 495062 - DNA, 15 bp, Homo sapiens
ttgggatatttttcc

SEQ ID NO: 495063 - DNA, 15 bp, Homo sapiens
tgggatatttttcct

SEQ ID NO: 495064 - DNA, 15 bp, Homo sapiens
gggatatttttcctg

SEQ ID NO: 495065 - DNA, 15 bp, Homo sapiens
ggatatttttcctgc

SEQ ID NO: 495066 - DNA, 15 bp, Homo sapiens
gatatttttcctgca

SEQ ID NO: 495067 - DNA, 15 bp, Homo sapiens
atatttttcctgcat

SEQ ID NO: 495068 - DNA, 15 bp, Homo sapiens
tatttttcctgcatt

SEQ ID NO: 495069 - DNA, 15 bp, Homo sapiens
atttttcctgcattt

SEQ ID NO: 495070 - DNA, 15 bp, Homo sapiens
tttttcctgcatttt

SEQ ID NO: 495071 - DNA, 15 bp, Homo sapiens
ttttcctgcatttta

SEQ ID NO: 495072 - DNA, 15 bp, Homo sapiens
tttcctgcattttat

SEQ ID NO: 495073 - DNA, 15 bp, Homo sapiens
ttcctgcattttatt

SEQ ID NO: 495074 - DNA, 15 bp, Homo sapiens
tcctgcattttattc

SEQ ID NO: 495075 - DNA, 15 bp, Homo sapiens
cctgcattttattcc

SEQ ID NO: 495076 - DNA, 15 bp, Homo sapiens
ctgcattttattccc

SEQ ID NO: 495077 - DNA, 15 bp, Homo sapiens
tgcattttattccct

SEQ ID NO: 495078 - DNA, 15 bp, Homo sapiens
gcattttattccctt

SEQ ID NO: 495079 - DNA, 15 bp, Homo sapiens
cattttattcccttt

SEQ ID NO: 495080 - DNA, 15 bp, Homo sapiens
attttattccctttt

SEQ ID NO: 495081 - DNA, 15 bp, Homo sapiens
ttttattcccttttt

SEQ ID NO: 495082 - DNA, 15 bp, Homo sapiens
tttattcccttttta

SEQ ID NO: 495083 - DNA, 15 bp, Homo sapiens
ttattccctttttat

SEQ ID NO: 495084 - DNA, 15 bp, Homo sapiens
tattccctttttata

SEQ ID NO: 495085 - DNA, 15 bp, Homo sapiens
attccctttttatat

SEQ ID NO: 495086 - DNA, 15 bp, Homo sapiens
ttccctttttatata

SEQ ID NO: 495087 - DNA, 15 bp, Homo sapiens
tccctttttatataa

SEQ ID NO: 495088 - DNA, 15 bp, Homo sapiens
ccctttttatataag

SEQ ID NO: 495089 - DNA, 15 bp, Homo sapiens
cctttttatataagt

SEQ ID NO: 495090 - DNA, 15 bp, Homo sapiens
ctttttatataagta

SEQ ID NO: 495091 - DNA, 15 bp, Homo sapiens
tttttatataagtag

SEQ ID NO: 495092 - DNA, 15 bp, Homo sapiens
ttttatataagtagg

SEQ ID NO: 495093 - DNA, 15 bp, Homo sapiens
tttatataagtagga

SEQ ID NO: 495094 - DNA, 15 bp, Homo sapiens
ttatataagtaggaa

SEQ ID NO: 495095 - DNA, 15 bp, Homo sapiens
tatataagtaggaat

SEQ ID NO: 495096 - DNA, 15 bp, Homo sapiens
atataagtaggaatt

SEQ ID NO: 495097 - DNA, 15 bp, Homo sapiens
tataagtaggaatta

SEQ ID NO: 495098 - DNA, 15 bp, Homo sapiens
ataagtaggaattaa

SEQ ID NO: 495099 - DNA, 15 bp, Homo sapiens
taagtaggaattaat

SEQ ID NO: 495100 - DNA, 15 bp, Homo sapiens
aagtaggaattaatt

SEQ ID NO: 495101 - DNA, 15 bp, Homo sapiens
agtaggaattaatta

SEQ ID NO: 495102 - DNA, 15 bp, Homo sapiens
gtaggaattaattat

SEQ ID NO: 495103 - DNA, 15 bp, Homo sapiens
taggaattaattatt

SEQ ID NO: 495104 - DNA, 15 bp, Homo sapiens
aggaattaattattt

SEQ ID NO: 495105 - DNA, 15 bp, Homo sapiens
ggaattaattattta

SEQ ID NO: 495106 - DNA, 15 bp, Homo sapiens
gaattaattatttat

SEQ ID NO: 495107 - DNA, 15 bp, Homo sapiens
aattaattatttatt

SEQ ID NO: 495108 - DNA, 15 bp, Homo sapiens
attaattatttattt

SEQ ID NO: 495109 - DNA, 15 bp, Homo sapiens
ttaattatttatttt

SEQ ID NO: 495110 - DNA, 15 bp, Homo sapiens
taattatttatttta

SEQ ID NO: 495111 - DNA, 15 bp, Homo sapiens
aattatttattttat

SEQ ID NO: 495112 - DNA, 15 bp, Homo sapiens
attatttattttatg

SEQ ID NO: 495113 - DNA, 15 bp, Homo sapiens
ttatttattttatgt

SEQ ID NO: 495114 - DNA, 15 bp, Homo sapiens
tatttattttatgtc

SEQ ID NO: 495115 - DNA, 15 bp, Homo sapiens
atttattttatgtct

SEQ ID NO: 495116 - DNA, 15 bp, Homo sapiens
tttattttatgtctt

SEQ ID NO: 495117 - DNA, 15 bp, Homo sapiens
ttattttatgtctta

SEQ ID NO: 495118 - DNA, 15 bp, Homo sapiens
tattttatgtcttaa

SEQ ID NO: 495119 - DNA, 15 bp, Homo sapiens
attttatgtcttaat

SEQ ID NO: 495120 - DNA, 15 bp, Homo sapiens
ttttatgtcttaatc

SEQ ID NO: 495121 - DNA, 15 bp, Homo sapiens
tttatgtcttaatct

SEQ ID NO: 495122 - DNA, 15 bp, Homo sapiens
ttatgtcttaatcta

SEQ ID NO: 495123 - DNA, 15 bp, Homo sapiens
tatgtcttaatctat

SEQ ID NO: 495124 - DNA, 15 bp, Homo sapiens
atgtcttaatctatt

SEQ ID NO: 495125 - DNA, 15 bp, Homo sapiens
tgtcttaatctattt

SEQ ID NO: 495126 - DNA, 15 bp, Homo sapiens
gtcttaatctatttg

SEQ ID NO: 495127 - DNA, 15 bp, Homo sapiens
tcttaatctatttga

SEQ ID NO: 495128 - DNA, 15 bp, Homo sapiens
cttaatctatttgat

SEQ ID NO: 495129 - DNA, 15 bp, Homo sapiens
ttaatctatttgata

SEQ ID NO: 495130 - DNA, 15 bp, Homo sapiens
taatctatttgataa

SEQ ID NO: 495131 - DNA, 15 bp, Homo sapiens
aatctatttgataaa

SEQ ID NO: 495132 - DNA, 15 bp, Homo sapiens
atctatttgataaag

SEQ ID NO: 495133 - DNA, 15 bp, Homo sapiens
tctatttgataaaga

SEQ ID NO: 495134 - DNA, 15 bp, Homo sapiens
ctatttgataaagaa

SEQ ID NO: 495135 - DNA, 15 bp, Homo sapiens
tatttgataaagaag

SEQ ID NO: 495136 - DNA, 15 bp, Homo sapiens
atttgataaagaaga

SEQ ID NO: 495137 - DNA, 15 bp, Homo sapiens
tttgataaagaagac

SEQ ID NO: 495138 - DNA, 15 bp, Homo sapiens
ttgataaagaagact

SEQ ID NO: 495139 - DNA, 15 bp, Homo sapiens
tgataaagaagacta

SEQ ID NO: 495140 - DNA, 15 bp, Homo sapiens
gataaagaagactac

SEQ ID NO: 495141 - DNA, 15 bp, Homo sapiens
ataaagaagactaca

SEQ ID NO: 495142 - DNA, 15 bp, Homo sapiens
taaagaagactacat

SEQ ID NO: 495143 - DNA, 15 bp, Homo sapiens
aaagaagactacatt

SEQ ID NO: 495144 - DNA, 15 bp, Homo sapiens
aagaagactacatta

SEQ ID NO: 495145 - DNA, 15 bp, Homo sapiens
agaagactacattat

SEQ ID NO: 495146 - DNA, 15 bp, Homo sapiens
gaagactacattata

SEQ ID NO: 495147 - DNA, 15 bp, Homo sapiens
aagactacattataa

SEQ ID NO: 495148 - DNA, 15 bp, Homo sapiens
agactacattataat

SEQ ID NO: 495149 - DNA, 15 bp, Homo sapiens
gactacattataata

SEQ ID NO: 495150 - DNA, 15 bp, Homo sapiens
actacattataataa

SEQ ID NO: 495151 - DNA, 15 bp, Homo sapiens
ctacattataataat

SEQ ID NO: 495152 - DNA, 15 bp, Homo sapiens
tacattataataatc

SEQ ID NO: 495153 - DNA, 15 bp, Homo sapiens
acattataataatct

SEQ ID NO: 495154 - DNA, 15 bp, Homo sapiens
cattataataatctc

SEQ ID NO: 495155 - DNA, 15 bp, Homo sapiens
attataataatctca

SEQ ID NO: 495156 - DNA, 15 bp, Homo sapiens
ttataataatctcaa

SEQ ID NO: 495157 - DNA, 15 bp, Homo sapiens
tataataatctcaaa

SEQ ID NO: 495158 - DNA, 15 bp, Homo sapiens
ataataatctcaaag

SEQ ID NO: 495159 - DNA, 15 bp, Homo sapiens
taataatctcaaaga

SEQ ID NO: 495160 - DNA, 15 bp, Homo sapiens
aataatctcaaagat

SEQ ID NO: 495161 - DNA, 15 bp, Homo sapiens
ataatctcaaagatc

SEQ ID NO: 495162 - DNA, 15 bp, Homo sapiens
taatctcaaagatca

SEQ ID NO: 495163 - DNA, 15 bp, Homo sapiens
aatctcaaagatcat

SEQ ID NO: 495164 - DNA, 15 bp, Homo sapiens
atctcaaagatcata

SEQ ID NO: 495165 - DNA, 15 bp, Homo sapiens
tctcaaagatcatat

SEQ ID NO: 495166 - DNA, 15 bp, Homo sapiens
ctcaaagatcatatt

SEQ ID NO: 495167 - DNA, 15 bp, Homo sapiens
tcaaagatcatatta

SEQ ID NO: 495168 - DNA, 15 bp, Homo sapiens
caaagatcatattac

SEQ ID NO: 495169 - DNA, 15 bp, Homo sapiens
aaagatcatattacc

SEQ ID NO: 495170 - DNA, 15 bp, Homo sapiens
aagatcatattacca

SEQ ID NO: 495171 - DNA, 15 bp, Homo sapiens
agatcatattaccaa

SEQ ID NO: 495172 - DNA, 15 bp, Homo sapiens
gatcatattaccaaa

SEQ ID NO: 495173 - DNA, 15 bp, Homo sapiens
atcatattaccaaag

SEQ ID NO: 495174 - DNA, 15 bp, Homo sapiens
tcatattaccaaagg

SEQ ID NO: 495175 - DNA, 15 bp, Homo sapiens
catattaccaaaggt

SEQ ID NO: 495176 - DNA, 15 bp, Homo sapiens
atattaccaaaggtt

SEQ ID NO: 495177 - DNA, 15 bp, Homo sapiens
tattaccaaaggttg

SEQ ID NO: 495178 - DNA, 15 bp, Homo sapiens
attaccaaaggttgc

SEQ ID NO: 495179 - DNA, 15 bp, Homo sapiens
ttaccaaaggttgcc

SEQ ID NO: 495180 - DNA, 15 bp, Homo sapiens
taccaaaggttgccc

SEQ ID NO: 495181 - DNA, 15 bp, Homo sapiens
accaaaggttgccca

SEQ ID NO: 495182 - DNA, 15 bp, Homo sapiens
ccaaaggttgcccac

SEQ ID NO: 495183 - DNA, 15 bp, Homo sapiens
caaaggttgcccact

SEQ ID NO: 495184 - DNA, 15 bp, Homo sapiens
aaaggttgcccactt

SEQ ID NO: 495185 - DNA, 15 bp, Homo sapiens
aaggttgcccacttg

SEQ ID NO: 495186 - DNA, 15 bp, Homo sapiens
aggttgcccacttga

SEQ ID NO: 495187 - DNA, 15 bp, Homo sapiens
ggttgcccacttgag

SEQ ID NO: 495188 - DNA, 15 bp, Homo sapiens
gttgcccacttgagc

SEQ ID NO: 495189 - DNA, 15 bp, Homo sapiens
ttgcccacttgagca

SEQ ID NO: 495190 - DNA, 15 bp, Homo sapiens
tgcccacttgagcat

SEQ ID NO: 495191 - DNA, 15 bp, Homo sapiens
gcccacttgagcata

SEQ ID NO: 495192 - DNA, 15 bp, Homo sapiens
cccacttgagcatat

SEQ ID NO: 495193 - DNA, 15 bp, Homo sapiens
ccacttgagcatatt

SEQ ID NO: 495194 - DNA, 15 bp, Homo sapiens
cacttgagcatattt

SEQ ID NO: 495195 - DNA, 15 bp, Homo sapiens
acttgagcatatttt

SEQ ID NO: 495196 - DNA, 15 bp, Homo sapiens
cttgagcatattttc

SEQ ID NO: 495197 - DNA, 15 bp, Homo sapiens
ttgagcatattttca

SEQ ID NO: 495198 - DNA, 15 bp, Homo sapiens
gcatattttcatttt

SEQ ID NO: 495199 - DNA, 15 bp, Homo sapiens
catattttcattttg

SEQ ID NO: 495200 - DNA, 15 bp, Homo sapiens
atattttcattttga

SEQ ID NO: 495201 - DNA, 15 bp, Homo sapiens
tattttcattttgac

SEQ ID NO: 495202 - DNA, 15 bp, Homo sapiens
attttcattttgaca

SEQ ID NO: 495203 - DNA, 15 bp, Homo sapiens
ttttcattttgacac

SEQ ID NO: 495204 - DNA, 15 bp, Homo sapiens
tttcattttgacaca

SEQ ID NO: 495205 - DNA, 15 bp, Homo sapiens
ttcattttgacacag

SEQ ID NO: 495206 - DNA, 15 bp, Homo sapiens
tcattttgacacaga

SEQ ID NO: 495207 - DNA, 15 bp, Homo sapiens
cattttgacacagaa

SEQ ID NO: 495208 - DNA, 15 bp, Homo sapiens
attttgacacagaaa

SEQ ID NO: 495209 - DNA, 15 bp, Homo sapiens
ttttgacacagaaac

SEQ ID NO: 495210 - DNA, 15 bp, Homo sapiens
tttgacacagaaaca

SEQ ID NO: 495211 - DNA, 15 bp, Homo sapiens
ttgacacagaaacaa

SEQ ID NO: 495212 - DNA, 15 bp, Homo sapiens
tgacacagaaacaaa

SEQ ID NO: 495213 - DNA, 15 bp, Homo sapiens
gacacagaaacaaaa

SEQ ID NO: 495214 - DNA, 15 bp, Homo sapiens
acacagaaacaaaat

SEQ ID NO: 495215 - DNA, 15 bp, Homo sapiens
cacagaaacaaaatt

SEQ ID NO: 495216 - DNA, 15 bp, Homo sapiens
acagaaacaaaattt

SEQ ID NO: 495217 - DNA, 15 bp, Homo sapiens
cagaaacaaaattta

SEQ ID NO: 495218 - DNA, 15 bp, Homo sapiens
agaaacaaaatttag

SEQ ID NO: 495219 - DNA, 15 bp, Homo sapiens
gaaacaaaatttagt

SEQ ID NO: 495220 - DNA, 15 bp, Homo sapiens
aaacaaaatttagta

SEQ ID NO: 495221 - DNA, 15 bp, Homo sapiens
aacaaaatttagtac

SEQ ID NO: 495222 - DNA, 15 bp, Homo sapiens
acaaaatttagtaca

SEQ ID NO: 495223 - DNA, 15 bp, Homo sapiens
caaaatttagtacaa

SEQ ID NO: 495224 - DNA, 15 bp, Homo sapiens
aaaatttagtacaac

SEQ ID NO: 495225 - DNA, 15 bp, Homo sapiens
aaatttagtacaacc

SEQ ID NO: 495226 - DNA, 15 bp, Homo sapiens
aatttagtacaacct

SEQ ID NO: 495227 - DNA, 15 bp, Homo sapiens
atttagtacaacctt

SEQ ID NO: 495228 - DNA, 15 bp, Homo sapiens
tttagtacaaccttt

SEQ ID NO: 495229 - DNA, 15 bp, Homo sapiens
ttagtacaacctttc

SEQ ID NO: 495230 - DNA, 15 bp, Homo sapiens
tagtacaacctttcc

SEQ ID NO: 495231 - DNA, 15 bp, Homo sapiens
agtacaacctttcct

SEQ ID NO: 495232 - DNA, 15 bp, Homo sapiens
gtacaacctttccta

SEQ ID NO: 495233 - DNA, 15 bp, Homo sapiens
tacaacctttcctag

SEQ ID NO: 495234 - DNA, 15 bp, Homo sapiens
acaacctttcctagt

SEQ ID NO: 495235 - DNA, 15 bp, Homo sapiens
caacctttcctagtt

SEQ ID NO: 495236 - DNA, 15 bp, Homo sapiens
aacctttcctagttc

SEQ ID NO: 495237 - DNA, 15 bp, Homo sapiens
acctttcctagttcc

SEQ ID NO: 495238 - DNA, 15 bp, Homo sapiens
cctttcctagttccc

SEQ ID NO: 495239 - DNA, 15 bp, Homo sapiens
ctttcctagttccca

SEQ ID NO: 495240 - DNA, 15 bp, Homo sapiens
tttcctagttcccat

SEQ ID NO: 495241 - DNA, 15 bp, Homo sapiens
ttcctagttcccatg

SEQ ID NO: 495242 - DNA, 15 bp, Homo sapiens
tcctagttcccatgt

SEQ ID NO: 495243 - DNA, 15 bp, Homo sapiens
cctagttcccatgtc

SEQ ID NO: 495244 - DNA, 15 bp, Homo sapiens
ctagttcccatgtct

SEQ ID NO: 495245 - DNA, 15 bp, Homo sapiens
tagttcccatgtctt

SEQ ID NO: 495246 - DNA, 15 bp, Homo sapiens
agttcccatgtcttg

SEQ ID NO: 495247 - DNA, 15 bp, Homo sapiens
gttcccatgtcttga

SEQ ID NO: 495248 - DNA, 15 bp, Homo sapiens
ttcccatgtcttgat

SEQ ID NO: 495249 - DNA, 15 bp, Homo sapiens
tcccatgtcttgatt

SEQ ID NO: 495250 - DNA, 15 bp, Homo sapiens
cccatgtcttgattt

SEQ ID NO: 495251 - DNA, 15 bp, Homo sapiens
ccatgtcttgatttt

SEQ ID NO: 495252 - DNA, 15 bp, Homo sapiens
catgtcttgattttc

SEQ ID NO: 495253 - DNA, 15 bp, Homo sapiens
atgtcttgattttca

SEQ ID NO: 495254 - DNA, 15 bp, Homo sapiens
tgtcttgattttcat

SEQ ID NO: 495255 - DNA, 15 bp, Homo sapiens
gtcttgattttcatc

SEQ ID NO: 495256 - DNA, 15 bp, Homo sapiens
tcttgattttcatca

SEQ ID NO: 495257 - DNA, 15 bp, Homo sapiens
cttgattttcatcat

SEQ ID NO: 495258 - DNA, 15 bp, Homo sapiens
ttgattttcatcatt

SEQ ID NO: 495259 - DNA, 15 bp, Homo sapiens
tgattttcatcatta

SEQ ID NO: 495260 - DNA, 15 bp, Homo sapiens
gattttcatcattac

SEQ ID NO: 495261 - DNA, 15 bp, Homo sapiens
attttcatcattaca

SEQ ID NO: 495262 - DNA, 15 bp, Homo sapiens
ttttcatcattacat

SEQ ID NO: 495263 - DNA, 15 bp, Homo sapiens
tttcatcattacatg

SEQ ID NO: 495264 - DNA, 15 bp, Homo sapiens
ttcatcattacatgc

SEQ ID NO: 495265 - DNA, 15 bp, Homo sapiens
tcatcattacatgca

SEQ ID NO: 495266 - DNA, 15 bp, Homo sapiens
catcattacatgcac

SEQ ID NO: 495267 - DNA, 15 bp, Homo sapiens
atcattacatgcaca

SEQ ID NO: 495268 - DNA, 15 bp, Homo sapiens
tcattacatgcacag

SEQ ID NO: 495269 - DNA, 15 bp, Homo sapiens
cattacatgcacagc

SEQ ID NO: 495270 - DNA, 15 bp, Homo sapiens
attacatgcacagca

SEQ ID NO: 495271 - DNA, 15 bp, Homo sapiens
ttacatgcacagcag

SEQ ID NO: 495272 - DNA, 15 bp, Homo sapiens
tacatgcacagcaga

SEQ ID NO: 495273 - DNA, 15 bp, Homo sapiens
acatgcacagcagac

SEQ ID NO: 495274 - DNA, 15 bp, Homo sapiens
catgcacagcagacc

SEQ ID NO: 495275 - DNA, 15 bp, Homo sapiens
atgcacagcagacct

SEQ ID NO: 495276 - DNA, 15 bp, Homo sapiens
tgcacagcagacctt

SEQ ID NO: 495277 - DNA, 15 bp, Homo sapiens
gcacagcagaccttt

SEQ ID NO: 495278 - DNA, 15 bp, Homo sapiens
cacagcagaccttta

SEQ ID NO: 495279 - DNA, 15 bp, Homo sapiens
acagcagacctttac

SEQ ID NO: 495280 - DNA, 15 bp, Homo sapiens
cagcagacctttacc

SEQ ID NO: 495281 - DNA, 15 bp, Homo sapiens
agcagacctttacct

SEQ ID NO: 495282 - DNA, 15 bp, Homo sapiens
gcagacctttaccta

SEQ ID NO: 495283 - DNA, 15 bp, Homo sapiens
cagacctttacctat

SEQ ID NO: 495284 - DNA, 15 bp, Homo sapiens
agacctttacctatt

SEQ ID NO: 495285 - DNA, 15 bp, Homo sapiens
gacctttacctattg

SEQ ID NO: 495286 - DNA, 15 bp, Homo sapiens
acctttacctattgt

SEQ ID NO: 495287 - DNA, 15 bp, Homo sapiens
cctttacctattgtg

SEQ ID NO: 495288 - DNA, 15 bp, Homo sapiens
ctttacctattgtga

SEQ ID NO: 495289 - DNA, 15 bp, Homo sapiens
tttacctattgtgat

SEQ ID NO: 495290 - DNA, 15 bp, Homo sapiens
ttacctattgtgata

SEQ ID NO: 495291 - DNA, 15 bp, Homo sapiens
tacctattgtgatac

SEQ ID NO: 495292 - DNA, 15 bp, Homo sapiens
acctattgtgatacc

SEQ ID NO: 495293 - DNA, 15 bp, Homo sapiens
cctattgtgatacca

SEQ ID NO: 495294 - DNA, 15 bp, Homo sapiens
ctattgtgataccag

SEQ ID NO: 495295 - DNA, 15 bp, Homo sapiens
tattgtgataccaga

SEQ ID NO: 495296 - DNA, 15 bp, Homo sapiens
attgtgataccagaa

SEQ ID NO: 495297 - DNA, 15 bp, Homo sapiens
ttgtgataccagaac

SEQ ID NO: 495298 - DNA, 15 bp, Homo sapiens
tgtgataccagaaca

SEQ ID NO: 495299 - DNA, 15 bp, Homo sapiens
gtgataccagaacac

SEQ ID NO: 495300 - DNA, 15 bp, Homo sapiens
tgataccagaacaca

SEQ ID NO: 495301 - DNA, 15 bp, Homo sapiens
gataccagaacacat

SEQ ID NO: 495302 - DNA, 15 bp, Homo sapiens
ataccagaacacatc

SEQ ID NO: 495303 - DNA, 15 bp, Homo sapiens
taccagaacacatca

SEQ ID NO: 495304 - DNA, 15 bp, Homo sapiens
accagaacacatcat

SEQ ID NO: 495305 - DNA, 15 bp, Homo sapiens
ccagaacacatcatt

SEQ ID NO: 495306 - DNA, 15 bp, Homo sapiens
cagaacacatcattg

SEQ ID NO: 495307 - DNA, 15 bp, Homo sapiens
agaacacatcattgt

SEQ ID NO: 495308 - DNA, 15 bp, Homo sapiens
gaacacatcattgtc

SEQ ID NO: 495309 - DNA, 15 bp, Homo sapiens
aacacatcattgtct

SEQ ID NO: 495310 - DNA, 15 bp, Homo sapiens
acacatcattgtctt

SEQ ID NO: 495311 - DNA, 15 bp, Homo sapiens
cacatcattgtcttt

SEQ ID NO: 495312 - DNA, 15 bp, Homo sapiens
acatcattgtctttg

SEQ ID NO: 495313 - DNA, 15 bp, Homo sapiens
catcattgtctttgg

SEQ ID NO: 495314 - DNA, 15 bp, Homo sapiens
atcattgtctttggt

SEQ ID NO: 495315 - DNA, 15 bp, Homo sapiens
tcattgtctttggtt

SEQ ID NO: 495316 - DNA, 15 bp, Homo sapiens
cattgtctttggttc

SEQ ID NO: 495317 - DNA, 15 bp, Homo sapiens
attgtctttggttcc

SEQ ID NO: 495318 - DNA, 15 bp, Homo sapiens
ttgtctttggttccc

SEQ ID NO: 495319 - DNA, 15 bp, Homo sapiens
tgtctttggttccct

SEQ ID NO: 495320 - DNA, 15 bp, Homo sapiens
gtctttggttccctt

SEQ ID NO: 495321 - DNA, 15 bp, Homo sapiens
tctttggttcccttc

SEQ ID NO: 495322 - DNA, 15 bp, Homo sapiens
ctttggttcccttca

SEQ ID NO: 495323 - DNA, 15 bp, Homo sapiens
tttggttcccttcaa

SEQ ID NO: 495324 - DNA, 15 bp, Homo sapiens
ttggttcccttcaaa

SEQ ID NO: 495325 - DNA, 15 bp, Homo sapiens
tggttcccttcaaag

SEQ ID NO: 495326 - DNA, 15 bp, Homo sapiens
ggttcccttcaaaga

SEQ ID NO: 495327 - DNA, 15 bp, Homo sapiens
gttcccttcaaagag

SEQ ID NO: 495328 - DNA, 15 bp, Homo sapiens
ttcccttcaaagaga

SEQ ID NO: 495329 - DNA, 15 bp, Homo sapiens
tcccttcaaagagaa

SEQ ID NO: 495330 - DNA, 15 bp, Homo sapiens
cccttcaaagagaat

SEQ ID NO: 495331 - DNA, 15 bp, Homo sapiens
ccttcaaagagaatt

SEQ ID NO: 495332 - DNA, 15 bp, Homo sapiens
cttcaaagagaattt

SEQ ID NO: 495333 - DNA, 15 bp, Homo sapiens
ttcaaagagaatttt

SEQ ID NO: 495334 - DNA, 15 bp, Homo sapiens
tcaaagagaatttta

SEQ ID NO: 495335 - DNA, 15 bp, Homo sapiens
caaagagaattttat

SEQ ID NO: 495336 - DNA, 15 bp, Homo sapiens
aaagagaattttatt

SEQ ID NO: 495337 - DNA, 15 bp, Homo sapiens
aagagaattttattg

SEQ ID NO: 495338 - DNA, 15 bp, Homo sapiens
agagaattttattgt

SEQ ID NO: 495339 - DNA, 15 bp, Homo sapiens
gagaattttattgtt

SEQ ID NO: 495340 - DNA, 15 bp, Homo sapiens
agaattttattgttg

SEQ ID NO: 495341 - DNA, 15 bp, Homo sapiens
gaattttattgttgt

SEQ ID NO: 495342 - DNA, 15 bp, Homo sapiens
aattttattgttgtt

SEQ ID NO: 495343 - DNA, 15 bp, Homo sapiens
attttattgttgttt

SEQ ID NO: 495344 - DNA, 15 bp, Homo sapiens
ttttattgttgtttt

SEQ ID NO: 495345 - DNA, 15 bp, Homo sapiens
tttattgttgttttg

SEQ ID NO: 495346 - DNA, 15 bp, Homo sapiens
ttattgttgttttgt

SEQ ID NO: 495347 - DNA, 15 bp, Homo sapiens
tattgttgttttgta

SEQ ID NO: 495348 - DNA, 15 bp, Homo sapiens
attgttgttttgtat

SEQ ID NO: 495349 - DNA, 15 bp, Homo sapiens
ttgttgttttgtatt

SEQ ID NO: 495350 - DNA, 15 bp, Homo sapiens
tgttgttttgtattt

SEQ ID NO: 495351 - DNA, 15 bp, Homo sapiens
gttgttttgtatttt

SEQ ID NO: 495352 - DNA, 15 bp, Homo sapiens
ttgttttgtattttc

SEQ ID NO: 495353 - DNA, 15 bp, Homo sapiens
tgttttgtattttca

SEQ ID NO: 495354 - DNA, 15 bp, Homo sapiens
gttttgtattttcaa

SEQ ID NO: 495355 - DNA, 15 bp, Homo sapiens
ttttgtattttcaag

SEQ ID NO: 495356 - DNA, 15 bp, Homo sapiens
tttgtattttcaagt

SEQ ID NO: 495357 - DNA, 15 bp, Homo sapiens
ttgtattttcaagtc

SEQ ID NO: 495358 - DNA, 15 bp, Homo sapiens
tgtattttcaagtcc

SEQ ID NO: 495359 - DNA, 15 bp, Homo sapiens
gtattttcaagtcct

SEQ ID NO: 495360 - DNA, 15 bp, Homo sapiens
tattttcaagtcctt

SEQ ID NO: 495361 - DNA, 15 bp, Homo sapiens
attttcaagtcctta

SEQ ID NO: 495362 - DNA, 15 bp, Homo sapiens
ttttcaagtccttaa

SEQ ID NO: 495363 - DNA, 15 bp, Homo sapiens
tttcaagtccttaat

SEQ ID NO: 495364 - DNA, 15 bp, Homo sapiens
ttcaagtccttaata

SEQ ID NO: 495365 - DNA, 15 bp, Homo sapiens
tcaagtccttaatag

SEQ ID NO: 495366 - DNA, 15 bp, Homo sapiens
caagtccttaatagt

SEQ ID NO: 495367 - DNA, 15 bp, Homo sapiens
aagtccttaatagtt

SEQ ID NO: 495368 - DNA, 15 bp, Homo sapiens
agtccttaatagttc

SEQ ID NO: 495369 - DNA, 15 bp, Homo sapiens
gtccttaatagttct

SEQ ID NO: 495370 - DNA, 15 bp, Homo sapiens
tccttaatagttctt

SEQ ID NO: 495371 - DNA, 15 bp, Homo sapiens
ccttaatagttcttg

SEQ ID NO: 495372 - DNA, 15 bp, Homo sapiens
cttaatagttcttga

SEQ ID NO: 495373 - DNA, 15 bp, Homo sapiens
ttaatagttcttgaa

SEQ ID NO: 495374 - DNA, 15 bp, Homo sapiens
taatagttcttgaaa

SEQ ID NO: 495375 - DNA, 15 bp, Homo sapiens
aatagttcttgaaac

SEQ ID NO: 495376 - DNA, 15 bp, Homo sapiens
atagttcttgaaact

SEQ ID NO: 495377 - DNA, 15 bp, Homo sapiens
tagttcttgaaactc

SEQ ID NO: 495378 - DNA, 15 bp, Homo sapiens
agttcttgaaactcc

SEQ ID NO: 495379 - DNA, 15 bp, Homo sapiens
gttcttgaaactcct

SEQ ID NO: 495380 - DNA, 15 bp, Homo sapiens
ttcttgaaactccta

SEQ ID NO: 495381 - DNA, 15 bp, Homo sapiens
tcttgaaactcctag

SEQ ID NO: 495382 - DNA, 15 bp, Homo sapiens
cttgaaactcctagt

SEQ ID NO: 495383 - DNA, 15 bp, Homo sapiens
ttgaaactcctagtt

SEQ ID NO: 495384 - DNA, 15 bp, Homo sapiens
tgaaactcctagttg

SEQ ID NO: 495385 - DNA, 15 bp, Homo sapiens
gaaactcctagttgt

SEQ ID NO: 495386 - DNA, 15 bp, Homo sapiens
aaactcctagttgtt

SEQ ID NO: 495387 - DNA, 15 bp, Homo sapiens
aactcctagttgttt

SEQ ID NO: 495388 - DNA, 15 bp, Homo sapiens
actcctagttgtttt

SEQ ID NO: 495389 - DNA, 15 bp, Homo sapiens
ctcctagttgttttc

SEQ ID NO: 495390 - DNA, 15 bp, Homo sapiens
tcctagttgttttct

SEQ ID NO: 495391 - DNA, 15 bp, Homo sapiens
cctagttgttttctt

SEQ ID NO: 495392 - DNA, 15 bp, Homo sapiens
ctagttgttttcttg

SEQ ID NO: 495393 - DNA, 15 bp, Homo sapiens
tagttgttttcttgt

SEQ ID NO: 495394 - DNA, 15 bp, Homo sapiens
agttgttttcttgtt

SEQ ID NO: 495395 - DNA, 15 bp, Homo sapiens
gttgttttcttgttg

SEQ ID NO: 495396 - DNA, 15 bp, Homo sapiens
ttgttttcttgttga

SEQ ID NO: 495397 - DNA, 15 bp, Homo sapiens
tgttttcttgttgaa

SEQ ID NO: 495398 - DNA, 15 bp, Homo sapiens
gttttcttgttgaaa

SEQ ID NO: 495399 - DNA, 15 bp, Homo sapiens
ttttcttgttgaaag

SEQ ID NO: 495400 - DNA, 15 bp, Homo sapiens
tttcttgttgaaagc

SEQ ID NO: 495401 - DNA, 15 bp, Homo sapiens
ttcttgttgaaagca

SEQ ID NO: 495402 - DNA, 15 bp, Homo sapiens
tcttgttgaaagcag

SEQ ID NO: 495403 - DNA, 15 bp, Homo sapiens
cttgttgaaagcaga

SEQ ID NO: 495404 - DNA, 15 bp, Homo sapiens
ttgttgaaagcagac

SEQ ID NO: 495405 - DNA, 15 bp, Homo sapiens
tgttgaaagcagaca

SEQ ID NO: 495406 - DNA, 15 bp, Homo sapiens
gttgaaagcagacac

SEQ ID NO: 495407 - DNA, 15 bp, Homo sapiens
ttgaaagcagacaca

SEQ ID NO: 495408 - DNA, 15 bp, Homo sapiens
tgaaagcagacacac

SEQ ID NO: 495409 - DNA, 15 bp, Homo sapiens
gaaagcagacacaca

SEQ ID NO: 495410 - DNA, 15 bp, Homo sapiens
aaagcagacacacat

SEQ ID NO: 495411 - DNA, 15 bp, Homo sapiens
aagcagacacacatt

SEQ ID NO: 495412 - DNA, 15 bp, Homo sapiens
agcagacacacattt

SEQ ID NO: 495413 - DNA, 15 bp, Homo sapiens
gcagacacacattta

SEQ ID NO: 495414 - DNA, 15 bp, Homo sapiens
cagacacacatttag

SEQ ID NO: 495415 - DNA, 15 bp, Homo sapiens
agacacacatttagt

SEQ ID NO: 495416 - DNA, 15 bp, Homo sapiens
gacacacatttagtg

SEQ ID NO: 495417 - DNA, 15 bp, Homo sapiens
acacacatttagtgc

SEQ ID NO: 495418 - DNA, 15 bp, Homo sapiens
cacacatttagtgca

SEQ ID NO: 495419 - DNA, 15 bp, Homo sapiens
acacatttagtgcac

SEQ ID NO: 495420 - DNA, 15 bp, Homo sapiens
cacatttagtgcacg

SEQ ID NO: 495421 - DNA, 15 bp, Homo sapiens
acatttagtgcacgg

SEQ ID NO: 495422 - DNA, 15 bp, Homo sapiens
catttagtgcacggc

SEQ ID NO: 495423 - DNA, 15 bp, Homo sapiens
atttagtgcacggct

SEQ ID NO: 495424 - DNA, 15 bp, Homo sapiens
tttagtgcacggctt

SEQ ID NO: 495425 - DNA, 15 bp, Homo sapiens
ttagtgcacggctta

SEQ ID NO: 495426 - DNA, 15 bp, Homo sapiens
tagtgcacggcttat

SEQ ID NO: 495427 - DNA, 15 bp, Homo sapiens
agtgcacggcttatt

SEQ ID NO: 495428 - DNA, 15 bp, Homo sapiens
gtgcacggcttattt

SEQ ID NO: 495429 - DNA, 15 bp, Homo sapiens
tgcacggcttatttt

SEQ ID NO: 495430 - DNA, 15 bp, Homo sapiens
gcacggcttatttta

SEQ ID NO: 495431 - DNA, 15 bp, Homo sapiens
cacggcttattttac

SEQ ID NO: 495432 - DNA, 15 bp, Homo sapiens
acggcttattttacc

SEQ ID NO: 495433 - DNA, 15 bp, Homo sapiens
cggcttattttacct

SEQ ID NO: 495434 - DNA, 15 bp, Homo sapiens
ggcttattttacctt

SEQ ID NO: 495435 - DNA, 15 bp, Homo sapiens
gcttattttaccttt

SEQ ID NO: 495436 - DNA, 15 bp, Homo sapiens
cttattttacctttc

SEQ ID NO: 495437 - DNA, 15 bp, Homo sapiens
ttattttacctttcg

SEQ ID NO: 495438 - DNA, 15 bp, Homo sapiens
tattttacctttcgg

SEQ ID NO: 495439 - DNA, 15 bp, Homo sapiens
attttacctttcggg

SEQ ID NO: 495440 - DNA, 15 bp, Homo sapiens
ttttacctttcgggt

SEQ ID NO: 495441 - DNA, 15 bp, Homo sapiens
tttacctttcgggtg

SEQ ID NO: 495442 - DNA, 15 bp, Homo sapiens
ttacctttcgggtga

SEQ ID NO: 495443 - DNA, 15 bp, Homo sapiens
tacctttcgggtgaa

SEQ ID NO: 495444 - DNA, 15 bp, Homo sapiens
acctttcgggtgaaa

SEQ ID NO: 495445 - DNA, 15 bp, Homo sapiens
cctttcgggtgaaag

SEQ ID NO: 495446 - DNA, 15 bp, Homo sapiens
ctttcgggtgaaaga

SEQ ID NO: 495447 - DNA, 15 bp, Homo sapiens
tttcgggtgaaagat

SEQ ID NO: 495448 - DNA, 15 bp, Homo sapiens
ttcgggtgaaagatc

SEQ ID NO: 495449 - DNA, 15 bp, Homo sapiens
tcgggtgaaagatca

SEQ ID NO: 495450 - DNA, 15 bp, Homo sapiens
cgggtgaaagatcag

SEQ ID NO: 495451 - DNA, 15 bp, Homo sapiens
gggtgaaagatcaga

SEQ ID NO: 495452 - DNA, 15 bp, Homo sapiens
ggtgaaagatcagat

SEQ ID NO: 495453 - DNA, 15 bp, Homo sapiens
gtgaaagatcagatg

SEQ ID NO: 495454 - DNA, 15 bp, Homo sapiens
tgaaagatcagatgt

SEQ ID NO: 495455 - DNA, 15 bp, Homo sapiens
gaaagatcagatgtt

SEQ ID NO: 495456 - DNA, 15 bp, Homo sapiens
aaagatcagatgttt

SEQ ID NO: 495457 - DNA, 15 bp, Homo sapiens
aagatcagatgtttt

SEQ ID NO: 495458 - DNA, 15 bp, Homo sapiens
agatcagatgttttt

SEQ ID NO: 495459 - DNA, 15 bp, Homo sapiens
gatcagatgttttta

SEQ ID NO: 495460 - DNA, 15 bp, Homo sapiens
atcagatgtttttat

SEQ ID NO: 495461 - DNA, 15 bp, Homo sapiens
tcagatgtttttata

SEQ ID NO: 495462 - DNA, 15 bp, Homo sapiens
cagatgtttttatac

SEQ ID NO: 495463 - DNA, 15 bp, Homo sapiens
agatgtttttatacc

SEQ ID NO: 495464 - DNA, 15 bp, Homo sapiens
gatgtttttataccc

SEQ ID NO: 495465 - DNA, 15 bp, Homo sapiens
atgtttttataccct

SEQ ID NO: 495466 - DNA, 15 bp, Homo sapiens
tgtttttataccctt

SEQ ID NO: 495467 - DNA, 15 bp, Homo sapiens
gtttttatacccttc

SEQ ID NO: 495468 - DNA, 15 bp, Homo sapiens
tttttatacccttca

SEQ ID NO: 495469 - DNA, 15 bp, Homo sapiens
ttttatacccttcac

SEQ ID NO: 495470 - DNA, 15 bp, Homo sapiens
tttatacccttcact

SEQ ID NO: 495471 - DNA, 15 bp, Homo sapiens
ttatacccttcactt

SEQ ID NO: 495472 - DNA, 15 bp, Homo sapiens
tatacccttcacttg

SEQ ID NO: 495473 - DNA, 15 bp, Homo sapiens
atacccttcacttga

SEQ ID NO: 495474 - DNA, 15 bp, Homo sapiens
tacccttcacttgat

SEQ ID NO: 495475 - DNA, 15 bp, Homo sapiens
acccttcacttgatc

SEQ ID NO: 495476 - DNA, 15 bp, Homo sapiens
cccttcacttgatca

SEQ ID NO: 495477 - DNA, 15 bp, Homo sapiens
ccttcacttgatcaa

SEQ ID NO: 495478 - DNA, 15 bp, Homo sapiens
cttcacttgatcaat

SEQ ID NO: 495479 - DNA, 15 bp, Homo sapiens
ttcacttgatcaata

SEQ ID NO: 495480 - DNA, 15 bp, Homo sapiens
tcacttgatcaatat

SEQ ID NO: 495481 - DNA, 15 bp, Homo sapiens
cacttgatcaatata

SEQ ID NO: 495482 - DNA, 15 bp, Homo sapiens
acttgatcaatatat

SEQ ID NO: 495483 - DNA, 15 bp, Homo sapiens
cttgatcaatatatt

SEQ ID NO: 495484 - DNA, 15 bp, Homo sapiens
ttgatcaatatattt

SEQ ID NO: 495485 - DNA, 15 bp, Homo sapiens
tgatcaatatatttg

SEQ ID NO: 495486 - DNA, 15 bp, Homo sapiens
gatcaatatatttgg

SEQ ID NO: 495487 - DNA, 15 bp, Homo sapiens
atcaatatatttgga

SEQ ID NO: 495488 - DNA, 15 bp, Homo sapiens
tcaatatatttggaa

SEQ ID NO: 495489 - DNA, 15 bp, Homo sapiens
caatatatttggaaa

SEQ ID NO: 495490 - DNA, 15 bp, Homo sapiens
aatatatttggaaag

SEQ ID NO: 495491 - DNA, 15 bp, Homo sapiens
atatatttggaaaga

SEQ ID NO: 495492 - DNA, 15 bp, Homo sapiens
tatatttggaaagaa

SEQ ID NO: 495493 - DNA, 15 bp, Homo sapiens
atatttggaaagaat

SEQ ID NO: 495494 - DNA, 15 bp, Homo sapiens
tatttggaaagaatg

SEQ ID NO: 495495 - DNA, 15 bp, Homo sapiens
atttggaaagaatgt

SEQ ID NO: 495496 - DNA, 15 bp, Homo sapiens
tttggaaagaatgtt

SEQ ID NO: 495497 - DNA, 15 bp, Homo sapiens
ttggaaagaatgttt

SEQ ID NO: 495498 - DNA, 15 bp, Homo sapiens
tggaaagaatgttta

SEQ ID NO: 495499 - DNA, 15 bp, Homo sapiens
ggaaagaatgtttat

SEQ ID NO: 495500 - DNA, 15 bp, Homo sapiens
gaaagaatgtttatc

SEQ ID NO: 495501 - DNA, 15 bp, Homo sapiens
aaagaatgtttatca

SEQ ID NO: 495502 - DNA, 15 bp, Homo sapiens
aagaatgtttatcaa

SEQ ID NO: 495503 - DNA, 15 bp, Homo sapiens
agaatgtttatcaaa

SEQ ID NO: 495504 - DNA, 15 bp, Homo sapiens
gaatgtttatcaaaa

SEQ ID NO: 495505 - DNA, 15 bp, Homo sapiens
aatgtttatcaaaag

SEQ ID NO: 495506 - DNA, 15 bp, Homo sapiens
atgtttatcaaaagt

SEQ ID NO: 495507 - DNA, 15 bp, Homo sapiens
tgtttatcaaaagtc

SEQ ID NO: 495508 - DNA, 15 bp, Homo sapiens
gtttatcaaaagtct

SEQ ID NO: 495509 - DNA, 15 bp, Homo sapiens
tttatcaaaagtcta

SEQ ID NO: 495510 - DNA, 15 bp, Homo sapiens
ttatcaaaagtctat

SEQ ID NO: 495511 - DNA, 15 bp, Homo sapiens
tatcaaaagtctatg

SEQ ID NO: 495512 - DNA, 15 bp, Homo sapiens
atcaaaagtctatgt

SEQ ID NO: 495513 - DNA, 15 bp, Homo sapiens
tcaaaagtctatgtc

SEQ ID NO: 495514 - DNA, 15 bp, Homo sapiens
caaaagtctatgtca

SEQ ID NO: 495515 - DNA, 15 bp, Homo sapiens
aaaagtctatgtcac

SEQ ID NO: 495516 - DNA, 15 bp, Homo sapiens
aaagtctatgtcact

SEQ ID NO: 495517 - DNA, 15 bp, Homo sapiens
aagtctatgtcactg

SEQ ID NO: 495518 - DNA, 15 bp, Homo sapiens
agtctatgtcactgc

SEQ ID NO: 495519 - DNA, 15 bp, Homo sapiens
gtctatgtcactgct

SEQ ID NO: 495520 - DNA, 15 bp, Homo sapiens
tctatgtcactgctt

SEQ ID NO: 495521 - DNA, 15 bp, Homo sapiens
ctatgtcactgcttc

SEQ ID NO: 495522 - DNA, 15 bp, Homo sapiens
tatgtcactgcttct

SEQ ID NO: 495523 - DNA, 15 bp, Homo sapiens
atgtcactgcttcta

SEQ ID NO: 495524 - DNA, 15 bp, Homo sapiens
tgtcactgcttctac

SEQ ID NO: 495525 - DNA, 15 bp, Homo sapiens
gtcactgcttctaca

SEQ ID NO: 495526 - DNA, 15 bp, Homo sapiens
tcactgcttctacag

SEQ ID NO: 495527 - DNA, 15 bp, Homo sapiens
cactgcttctacaga

SEQ ID NO: 495528 - DNA, 15 bp, Homo sapiens
actgcttctacagaa

SEQ ID NO: 495529 - DNA, 15 bp, Homo sapiens
ctgcttctacagaag

SEQ ID NO: 495530 - DNA, 15 bp, Homo sapiens
tgcttctacagaaga

SEQ ID NO: 495531 - DNA, 15 bp, Homo sapiens
gcttctacagaagaa

SEQ ID NO: 495532 - DNA, 15 bp, Homo sapiens
cttctacagaagaat

SEQ ID NO: 495533 - DNA, 15 bp, Homo sapiens
ttctacagaagaatg

SEQ ID NO: 495534 - DNA, 15 bp, Homo sapiens
tctacagaagaatga

SEQ ID NO: 495535 - DNA, 15 bp, Homo sapiens
ctacagaagaatgaa

SEQ ID NO: 495536 - DNA, 15 bp, Homo sapiens
tacagaagaatgaaa

SEQ ID NO: 495537 - DNA, 15 bp, Homo sapiens
acagaagaatgaaat

SEQ ID NO: 495538 - DNA, 15 bp, Homo sapiens
cagaagaatgaaatt

SEQ ID NO: 495539 - DNA, 15 bp, Homo sapiens
agaagaatgaaatta

SEQ ID NO: 495540 - DNA, 15 bp, Homo sapiens
gaagaatgaaattaa

SEQ ID NO: 495541 - DNA, 15 bp, Homo sapiens
aagaatgaaattaat

SEQ ID NO: 495542 - DNA, 15 bp, Homo sapiens
agaatgaaattaatg

SEQ ID NO: 495543 - DNA, 15 bp, Homo sapiens
gaatgaaattaatgc

SEQ ID NO: 495544 - DNA, 15 bp, Homo sapiens
aatgaaattaatgct

SEQ ID NO: 495545 - DNA, 15 bp, Homo sapiens
atgaaattaatgctt

SEQ ID NO: 495546 - DNA, 15 bp, Homo sapiens
tgaaattaatgctta

SEQ ID NO: 495547 - DNA, 15 bp, Homo sapiens
gaaattaatgcttag

SEQ ID NO: 495548 - DNA, 15 bp, Homo sapiens
aaattaatgcttagg

SEQ ID NO: 495549 - DNA, 15 bp, Homo sapiens
aattaatgcttaggt

SEQ ID NO: 495550 - DNA, 15 bp, Homo sapiens
attaatgcttaggtg

SEQ ID NO: 495551 - DNA, 15 bp, Homo sapiens
ttaatgcttaggtga

SEQ ID NO: 495552 - DNA, 15 bp, Homo sapiens
taatgcttaggtgat

SEQ ID NO: 495553 - DNA, 15 bp, Homo sapiens
aatgcttaggtgatg

SEQ ID NO: 495554 - DNA, 15 bp, Homo sapiens
atgcttaggtgatgg

SEQ ID NO: 495555 - DNA, 15 bp, Homo sapiens
tgcttaggtgatggt

SEQ ID NO: 495556 - DNA, 15 bp, Homo sapiens
gcttaggtgatggta

SEQ ID NO: 495557 - DNA, 15 bp, Homo sapiens
cttaggtgatggtac

SEQ ID NO: 495558 - DNA, 15 bp, Homo sapiens
ttaggtgatggtacc

SEQ ID NO: 495559 - DNA, 15 bp, Homo sapiens
taggtgatggtacct

SEQ ID NO: 495560 - DNA, 15 bp, Homo sapiens
aggtgatggtacctc

SEQ ID NO: 495561 - DNA, 15 bp, Homo sapiens
ggtgatggtacctcc

SEQ ID NO: 495562 - DNA, 15 bp, Homo sapiens
gtgatggtacctcca

SEQ ID NO: 495563 - DNA, 15 bp, Homo sapiens
tgatggtacctccac

SEQ ID NO: 495564 - DNA, 15 bp, Homo sapiens
gatggtacctccacc

SEQ ID NO: 495565 - DNA, 15 bp, Homo sapiens
atggtacctccacct

SEQ ID NO: 495566 - DNA, 15 bp, Homo sapiens
tggtacctccaccta

SEQ ID NO: 495567 - DNA, 15 bp, Homo sapiens
ggtacctccacctac

SEQ ID NO: 495568 - DNA, 15 bp, Homo sapiens
gtacctccacctaca

SEQ ID NO: 495569 - DNA, 15 bp, Homo sapiens
tacctccacctacat

SEQ ID NO: 495570 - DNA, 15 bp, Homo sapiens
acctccacctacatc

SEQ ID NO: 495571 - DNA, 15 bp, Homo sapiens
cctccacctacatct

SEQ ID NO: 495572 - DNA, 15 bp, Homo sapiens
ctccacctacatctt

SEQ ID NO: 495573 - DNA, 15 bp, Homo sapiens
tccacctacatcttt

SEQ ID NO: 495574 - DNA, 15 bp, Homo sapiens
ccacctacatctttt

SEQ ID NO: 495575 - DNA, 15 bp, Homo sapiens
cacctacatcttttt

SEQ ID NO: 495576 - DNA, 15 bp, Homo sapiens
acctacatctttttg

SEQ ID NO: 495577 - DNA, 15 bp, Homo sapiens
cctacatctttttga

SEQ ID NO: 495578 - DNA, 15 bp, Homo sapiens
ctacatctttttgag

SEQ ID NO: 495579 - DNA, 15 bp, Homo sapiens
tacatctttttgagt

SEQ ID NO: 495580 - DNA, 15 bp, Homo sapiens
acatctttttgagtg

SEQ ID NO: 495581 - DNA, 15 bp, Homo sapiens
catctttttgagtgc

SEQ ID NO: 495582 - DNA, 15 bp, Homo sapiens
atctttttgagtgca

SEQ ID NO: 495583 - DNA, 15 bp, Homo sapiens
tctttttgagtgcat

SEQ ID NO: 495584 - DNA, 15 bp, Homo sapiens
ctttttgagtgcatt

SEQ ID NO: 495585 - DNA, 15 bp, Homo sapiens
tttttgagtgcattc

SEQ ID NO: 495586 - DNA, 15 bp, Homo sapiens
ttttgagtgcattca

SEQ ID NO: 495587 - DNA, 15 bp, Homo sapiens
tttgagtgcattcaa

SEQ ID NO: 495588 - DNA, 15 bp, Homo sapiens
ttgagtgcattcaat

SEQ ID NO: 495589 - DNA, 15 bp, Homo sapiens
tgagtgcattcaatt

SEQ ID NO: 495590 - DNA, 15 bp, Homo sapiens
gagtgcattcaatta

SEQ ID NO: 495591 - DNA, 15 bp, Homo sapiens
agtgcattcaattat

SEQ ID NO: 495592 - DNA, 15 bp, Homo sapiens
gtgcattcaattatg

SEQ ID NO: 495593 - DNA, 15 bp, Homo sapiens
tgcattcaattatgt

SEQ ID NO: 495594 - DNA, 15 bp, Homo sapiens
gcattcaattatgta

SEQ ID NO: 495595 - DNA, 15 bp, Homo sapiens
cattcaattatgtat

SEQ ID NO: 495596 - DNA, 15 bp, Homo sapiens
attcaattatgtatt

SEQ ID NO: 495597 - DNA, 15 bp, Homo sapiens
ttcaattatgtattt

SEQ ID NO: 495598 - DNA, 15 bp, Homo sapiens
tcaattatgtatttt

SEQ ID NO: 495599 - DNA, 15 bp, Homo sapiens
caattatgtattttg

SEQ ID NO: 495600 - DNA, 15 bp, Homo sapiens
aattatgtattttgg

SEQ ID NO: 495601 - DNA, 15 bp, Homo sapiens
attatgtattttggt

SEQ ID NO: 495602 - DNA, 15 bp, Homo sapiens
ttatgtattttggtt

SEQ ID NO: 495603 - DNA, 15 bp, Homo sapiens
tatgtattttggttt

SEQ ID NO: 495604 - DNA, 15 bp, Homo sapiens
atgtattttggttta

SEQ ID NO: 495605 - DNA, 15 bp, Homo sapiens
tgtattttggtttag

SEQ ID NO: 495606 - DNA, 15 bp, Homo sapiens
gtattttggtttagc

SEQ ID NO: 495607 - DNA, 15 bp, Homo sapiens
tattttggtttagct

SEQ ID NO: 495608 - DNA, 15 bp, Homo sapiens
attttggtttagctt

SEQ ID NO: 495609 - DNA, 15 bp, Homo sapiens
ttttggtttagcttc

SEQ ID NO: 495610 - DNA, 15 bp, Homo sapiens
tttggtttagcttct

SEQ ID NO: 495611 - DNA, 15 bp, Homo sapiens
ttggtttagcttctg

SEQ ID NO: 495612 - DNA, 15 bp, Homo sapiens
tggtttagcttctga

SEQ ID NO: 495613 - DNA, 15 bp, Homo sapiens
ggtttagcttctgat

SEQ ID NO: 495614 - DNA, 15 bp, Homo sapiens
gtttagcttctgatt

SEQ ID NO: 495615 - DNA, 15 bp, Homo sapiens
ttagcttctgattta

SEQ ID NO: 495616 - DNA, 15 bp, Homo sapiens
tagcttctgatttaa

SEQ ID NO: 495617 - DNA, 15 bp, Homo sapiens
agcttctgatttaac

SEQ ID NO: 495618 - DNA, 15 bp, Homo sapiens
gcttctgatttaaca

SEQ ID NO: 495619 - DNA, 15 bp, Homo sapiens
tctgatttaacattt

SEQ ID NO: 495620 - DNA, 15 bp, Homo sapiens
ctgatttaacattta

SEQ ID NO: 495621 - DNA, 15 bp, Homo sapiens
tgatttaacatttaa

SEQ ID NO: 495622 - DNA, 15 bp, Homo sapiens
gatttaacatttaat

SEQ ID NO: 495623 - DNA, 15 bp, Homo sapiens
atttaacatttaatt

SEQ ID NO: 495624 - DNA, 15 bp, Homo sapiens
tttaacatttaattg

SEQ ID NO: 495625 - DNA, 15 bp, Homo sapiens
ttaacatttaattga

SEQ ID NO: 495626 - DNA, 15 bp, Homo sapiens
taacatttaattgat

SEQ ID NO: 495627 - DNA, 15 bp, Homo sapiens
aacatttaattgatt

SEQ ID NO: 495628 - DNA, 15 bp, Homo sapiens
acatttaattgattc

SEQ ID NO: 495629 - DNA, 15 bp, Homo sapiens
catttaattgattca

SEQ ID NO: 495630 - DNA, 15 bp, Homo sapiens
atttaattgattcag

SEQ ID NO: 495631 - DNA, 15 bp, Homo sapiens
tttaattgattcagt

SEQ ID NO: 495632 - DNA, 15 bp, Homo sapiens
ttaattgattcagtt

SEQ ID NO: 495633 - DNA, 15 bp, Homo sapiens
taattgattcagttt

SEQ ID NO: 495634 - DNA, 15 bp, Homo sapiens
aattgattcagttta

SEQ ID NO: 495635 - DNA, 15 bp, Homo sapiens
attgattcagtttaa

SEQ ID NO: 495636 - DNA, 15 bp, Homo sapiens
ttgattcagtttaaa

SEQ ID NO: 495637 - DNA, 15 bp, Homo sapiens
tgattcagtttaaac

SEQ ID NO: 495638 - DNA, 15 bp, Homo sapiens
gattcagtttaaaca

SEQ ID NO: 495639 - DNA, 15 bp, Homo sapiens
attcagtttaaacat

SEQ ID NO: 495640 - DNA, 15 bp, Homo sapiens
ttcagtttaaacatg

SEQ ID NO: 495641 - DNA, 15 bp, Homo sapiens
tcagtttaaacatgt

SEQ ID NO: 495642 - DNA, 15 bp, Homo sapiens
cagtttaaacatgtt

SEQ ID NO: 495643 - DNA, 15 bp, Homo sapiens
agtttaaacatgtta

SEQ ID NO: 495644 - DNA, 15 bp, Homo sapiens
gtttaaacatgttac

SEQ ID NO: 495645 - DNA, 15 bp, Homo sapiens
tttaaacatgttact

SEQ ID NO: 495646 - DNA, 15 bp, Homo sapiens
ttaaacatgttactt

SEQ ID NO: 495647 - DNA, 15 bp, Homo sapiens
taaacatgttactta

SEQ ID NO: 495648 - DNA, 15 bp, Homo sapiens
aaacatgttacttaa

SEQ ID NO: 495649 - DNA, 15 bp, Homo sapiens
aacatgttacttaat

SEQ ID NO: 495650 - DNA, 15 bp, Homo sapiens
acatgttacttaatt

SEQ ID NO: 495651 - DNA, 15 bp, Homo sapiens
catgttacttaatta

SEQ ID NO: 495652 - DNA, 15 bp, Homo sapiens
atgttacttaattag

SEQ ID NO: 495653 - DNA, 15 bp, Homo sapiens
tgttacttaattagc

SEQ ID NO: 495654 - DNA, 15 bp, Homo sapiens
gttacttaattagca

SEQ ID NO: 495655 - DNA, 15 bp, Homo sapiens
ttacttaattagcaa

SEQ ID NO: 495656 - DNA, 15 bp, Homo sapiens
tacttaattagcaaa

SEQ ID NO: 495657 - DNA, 15 bp, Homo sapiens
acttaattagcaaat

SEQ ID NO: 495658 - DNA, 15 bp, Homo sapiens
cttaattagcaaatg

SEQ ID NO: 495659 - DNA, 15 bp, Homo sapiens
ttaattagcaaatgt

SEQ ID NO: 495660 - DNA, 15 bp, Homo sapiens
taattagcaaatgta

SEQ ID NO: 495661 - DNA, 15 bp, Homo sapiens
aattagcaaatgtag

SEQ ID NO: 495662 - DNA, 15 bp, Homo sapiens
attagcaaatgtaga

SEQ ID NO: 495663 - DNA, 15 bp, Homo sapiens
ttagcaaatgtagag

SEQ ID NO: 495664 - DNA, 15 bp, Homo sapiens
tagcaaatgtagagg

SEQ ID NO: 495665 - DNA, 15 bp, Homo sapiens
agcaaatgtagagga

SEQ ID NO: 495666 - DNA, 15 bp, Homo sapiens
gcaaatgtagaggaa

SEQ ID NO: 495667 - DNA, 15 bp, Homo sapiens
caaatgtagaggaac

SEQ ID NO: 495668 - DNA, 15 bp, Homo sapiens
aaatgtagaggaacc

SEQ ID NO: 495669 - DNA, 15 bp, Homo sapiens
aatgtagaggaacca

SEQ ID NO: 495670 - DNA, 15 bp, Homo sapiens
atgtagaggaaccaa

SEQ ID NO: 495671 - DNA, 15 bp, Homo sapiens
tgtagaggaaccaaa

SEQ ID NO: 495672 - DNA, 15 bp, Homo sapiens
gtagaggaaccaaaa

SEQ ID NO: 495673 - DNA, 15 bp, Homo sapiens
tagaggaaccaaaaa

SEQ ID NO: 495674 - DNA, 15 bp, Homo sapiens
agaggaaccaaaaaa

SEQ ID NO: 495675 - DNA, 15 bp, Homo sapiens
gaggaaccaaaaaaa

SEQ ID NO: 495676 - DNA, 15 bp, Homo sapiens
aggaaccaaaaaaag

SEQ ID NO: 495677 - DNA, 15 bp, Homo sapiens
ggaaccaaaaaaagg

SEQ ID NO: 495678 - DNA, 15 bp, Homo sapiens
gaaccaaaaaaaggt

SEQ ID NO: 495679 - DNA, 15 bp, Homo sapiens
aaccaaaaaaaggtg

SEQ ID NO: 495680 - DNA, 15 bp, Homo sapiens
accaaaaaaaggtga

SEQ ID NO: 495681 - DNA, 15 bp, Homo sapiens
ccaaaaaaaggtgaa

SEQ ID NO: 495682 - DNA, 15 bp, Homo sapiens
caaaaaaaggtgaaa

SEQ ID NO: 495683 - DNA, 15 bp, Homo sapiens
aaaaaaaggtgaaaa

SEQ ID NO: 495684 - DNA, 15 bp, Homo sapiens
aaaaaaggtgaaaat

SEQ ID NO: 495685 - DNA, 15 bp, Homo sapiens
aaaaaggtgaaaata

SEQ ID NO: 495686 - DNA, 15 bp, Homo sapiens
aaaaggtgaaaataa

SEQ ID NO: 495687 - DNA, 15 bp, Homo sapiens
aaaggtgaaaataat

SEQ ID NO: 495688 - DNA, 15 bp, Homo sapiens
aaggtgaaaataata

SEQ ID NO: 495689 - DNA, 15 bp, Homo sapiens
aggtgaaaataatat

SEQ ID NO: 495690 - DNA, 15 bp, Homo sapiens
ggtgaaaataatatg

SEQ ID NO: 495691 - DNA, 15 bp, Homo sapiens
gtgaaaataatatgt

SEQ ID NO: 495692 - DNA, 15 bp, Homo sapiens
tgaaaataatatgtt

SEQ ID NO: 495693 - DNA, 15 bp, Homo sapiens
gaaaataatatgttt

SEQ ID NO: 495694 - DNA, 15 bp, Homo sapiens
aaaataatatgtttt

SEQ ID NO: 495695 - DNA, 15 bp, Homo sapiens
aaataatatgttttg

SEQ ID NO: 495696 - DNA, 15 bp, Homo sapiens
aataatatgttttga

SEQ ID NO: 495697 - DNA, 15 bp, Homo sapiens
ataatatgttttgat

SEQ ID NO: 495698 - DNA, 15 bp, Homo sapiens
taatatgttttgatt

SEQ ID NO: 495699 - DNA, 15 bp, Homo sapiens
aatatgttttgattc

SEQ ID NO: 495700 - DNA, 15 bp, Homo sapiens
atatgttttgattca

SEQ ID NO: 495701 - DNA, 15 bp, Homo sapiens
tatgttttgattcaa

SEQ ID NO: 495702 - DNA, 15 bp, Homo sapiens
atgttttgattcaaa

SEQ ID NO: 495703 - DNA, 15 bp, Homo sapiens
tgttttgattcaaac

SEQ ID NO: 495704 - DNA, 15 bp, Homo sapiens
gttttgattcaaacc

SEQ ID NO: 495705 - DNA, 15 bp, Homo sapiens
ttttgattcaaacct

SEQ ID NO: 495706 - DNA, 15 bp, Homo sapiens
tttgattcaaaccta

SEQ ID NO: 495707 - DNA, 15 bp, Homo sapiens
ttgattcaaacctaa

SEQ ID NO: 495708 - DNA, 15 bp, Homo sapiens
tgattcaaacctaaa

SEQ ID NO: 495709 - DNA, 15 bp, Homo sapiens
gattcaaacctaaag

SEQ ID NO: 495710 - DNA, 15 bp, Homo sapiens
attcaaacctaaaga

SEQ ID NO: 495711 - DNA, 15 bp, Homo sapiens
ttcaaacctaaagac

SEQ ID NO: 495712 - DNA, 15 bp, Homo sapiens
tcaaacctaaagaca

SEQ ID NO: 495713 - DNA, 15 bp, Homo sapiens
caaacctaaagacat

SEQ ID NO: 495714 - DNA, 15 bp, Homo sapiens
aaacctaaagacata

SEQ ID NO: 495715 - DNA, 15 bp, Homo sapiens
aacctaaagacataa

SEQ ID NO: 495716 - DNA, 15 bp, Homo sapiens
acctaaagacataaa

SEQ ID NO: 495717 - DNA, 15 bp, Homo sapiens
cctaaagacataaaa

SEQ ID NO: 495718 - DNA, 15 bp, Homo sapiens
ctaaagacataaaaa

SEQ ID NO: 495719 - DNA, 15 bp, Homo sapiens
taaagacataaaaac

SEQ ID NO: 495720 - DNA, 15 bp, Homo sapiens
aaagacataaaaaca

SEQ ID NO: 495721 - DNA, 15 bp, Homo sapiens
aagacataaaaacat

SEQ ID NO: 495722 - DNA, 15 bp, Homo sapiens
agacataaaaacata

SEQ ID NO: 495723 - DNA, 15 bp, Homo sapiens
gacataaaaacataa

SEQ ID NO: 495724 - DNA, 15 bp, Homo sapiens
acataaaaacataaa

SEQ ID NO: 495725 - DNA, 15 bp, Homo sapiens
cataaaaacataaag

SEQ ID NO: 495726 - DNA, 15 bp, Homo sapiens
ataaaaacataaaga

SEQ ID NO: 495727 - DNA, 15 bp, Homo sapiens
taaaaacataaagac

SEQ ID NO: 495728 - DNA, 15 bp, Homo sapiens
aaaaacataaagaca

SEQ ID NO: 495729 - DNA, 15 bp, Homo sapiens
aaaacataaagacat

SEQ ID NO: 495730 - DNA, 15 bp, Homo sapiens
aaacataaagacatt

SEQ ID NO: 495731 - DNA, 15 bp, Homo sapiens
aacataaagacattt

SEQ ID NO: 495732 - DNA, 15 bp, Homo sapiens
acataaagacatttt

SEQ ID NO: 495733 - DNA, 15 bp, Homo sapiens
cataaagacatttta

SEQ ID NO: 495734 - DNA, 15 bp, Homo sapiens
ataaagacattttaa

SEQ ID NO: 495735 - DNA, 15 bp, Homo sapiens
taaagacattttaac

SEQ ID NO: 495736 - DNA, 15 bp, Homo sapiens
aaagacattttaact

SEQ ID NO: 495737 - DNA, 15 bp, Homo sapiens
aagacattttaactt

SEQ ID NO: 495738 - DNA, 15 bp, Homo sapiens
agacattttaacttt

SEQ ID NO: 495739 - DNA, 15 bp, Homo sapiens
gacattttaactttg

SEQ ID NO: 495740 - DNA, 15 bp, Homo sapiens
acattttaactttgg

SEQ ID NO: 495741 - DNA, 15 bp, Homo sapiens
cattttaactttggg

SEQ ID NO: 495742 - DNA, 15 bp, Homo sapiens
attttaactttgggt

SEQ ID NO: 495743 - DNA, 15 bp, Homo sapiens
ttttaactttgggtt

SEQ ID NO: 495744 - DNA, 15 bp, Homo sapiens
tttaactttgggttc

SEQ ID NO: 495745 - DNA, 15 bp, Homo sapiens
ttaactttgggttct

SEQ ID NO: 495746 - DNA, 15 bp, Homo sapiens
taactttgggttctc

SEQ ID NO: 495747 - DNA, 15 bp, Homo sapiens
aactttgggttctct

SEQ ID NO: 495748 - DNA, 15 bp, Homo sapiens
actttgggttctctt

SEQ ID NO: 495749 - DNA, 15 bp, Homo sapiens
ctttgggttctcttt

SEQ ID NO: 495750 - DNA, 15 bp, Homo sapiens
tttgggttctcttta

SEQ ID NO: 495751 - DNA, 15 bp, Homo sapiens
ttgggttctctttag

SEQ ID NO: 495752 - DNA, 15 bp, Homo sapiens
tgggttctctttagc

SEQ ID NO: 495753 - DNA, 15 bp, Homo sapiens
gggttctctttagct

SEQ ID NO: 495754 - DNA, 15 bp, Homo sapiens
ggttctctttagctg

SEQ ID NO: 495755 - DNA, 15 bp, Homo sapiens
gttctctttagctgg

SEQ ID NO: 495756 - DNA, 15 bp, Homo sapiens
ttctctttagctggg

SEQ ID NO: 495757 - DNA, 15 bp, Homo sapiens
tctctttagctggga

SEQ ID NO: 495758 - DNA, 15 bp, Homo sapiens
ctctttagctgggat

SEQ ID NO: 495759 - DNA, 15 bp, Homo sapiens
tctttagctgggatc

SEQ ID NO: 495760 - DNA, 15 bp, Homo sapiens
ctttagctgggatct

SEQ ID NO: 495761 - DNA, 15 bp, Homo sapiens
tttagctgggatctg

SEQ ID NO: 495762 - DNA, 15 bp, Homo sapiens
ttagctgggatctgg

SEQ ID NO: 495763 - DNA, 15 bp, Homo sapiens
tagctgggatctggc

SEQ ID NO: 495764 - DNA, 15 bp, Homo sapiens
agctgggatctggcc

SEQ ID NO: 495765 - DNA, 15 bp, Homo sapiens
gctgggatctggcca

SEQ ID NO: 495766 - DNA, 15 bp, Homo sapiens
ctgggatctggccag

SEQ ID NO: 495767 - DNA, 15 bp, Homo sapiens
tgggatctggccaga

SEQ ID NO: 495768 - DNA, 15 bp, Homo sapiens
gggatctggccagaa

SEQ ID NO: 495769 - DNA, 15 bp, Homo sapiens
ggatctggccagaag

SEQ ID NO: 495770 - DNA, 15 bp, Homo sapiens
gatctggccagaagg

SEQ ID NO: 495771 - DNA, 15 bp, Homo sapiens
atctggccagaagga

SEQ ID NO: 495772 - DNA, 15 bp, Homo sapiens
tctggccagaaggag

SEQ ID NO: 495773 - DNA, 15 bp, Homo sapiens
ctggccagaaggagg

SEQ ID NO: 495774 - DNA, 15 bp, Homo sapiens
tggccagaaggaggc

SEQ ID NO: 495775 - DNA, 15 bp, Homo sapiens
ggccagaaggaggct

SEQ ID NO: 495776 - DNA, 15 bp, Homo sapiens
gccagaaggaggctt

SEQ ID NO: 495777 - DNA, 15 bp, Homo sapiens
ccagaaggaggctta

SEQ ID NO: 495778 - DNA, 15 bp, Homo sapiens
cagaaggaggcttaa

SEQ ID NO: 495779 - DNA, 15 bp, Homo sapiens
agaaggaggcttaaa

SEQ ID NO: 495780 - DNA, 15 bp, Homo sapiens
gaaggaggcttaaag

SEQ ID NO: 495781 - DNA, 15 bp, Homo sapiens
aaggaggcttaaagt

SEQ ID NO: 495782 - DNA, 15 bp, Homo sapiens
aggaggcttaaagtt

SEQ ID NO: 495783 - DNA, 15 bp, Homo sapiens
ggaggcttaaagtta

SEQ ID NO: 495784 - DNA, 15 bp, Homo sapiens
gaggcttaaagttag

SEQ ID NO: 495785 - DNA, 15 bp, Homo sapiens
aggcttaaagttaga

SEQ ID NO: 495786 - DNA, 15 bp, Homo sapiens
ggcttaaagttagaa

SEQ ID NO: 495787 - DNA, 15 bp, Homo sapiens
gcttaaagttagaaa

SEQ ID NO: 495788 - DNA, 15 bp, Homo sapiens
cttaaagttagaaat

SEQ ID NO: 495789 - DNA, 15 bp, Homo sapiens
ttaaagttagaaatt

SEQ ID NO: 495790 - DNA, 15 bp, Homo sapiens
taaagttagaaattg

SEQ ID NO: 495791 - DNA, 15 bp, Homo sapiens
aaagttagaaattgc

SEQ ID NO: 495792 - DNA, 15 bp, Homo sapiens
aagttagaaattgct

SEQ ID NO: 495793 - DNA, 15 bp, Homo sapiens
agttagaaattgcta

SEQ ID NO: 495794 - DNA, 15 bp, Homo sapiens
gttagaaattgctat

SEQ ID NO: 495795 - DNA, 15 bp, Homo sapiens
ttagaaattgctatt

SEQ ID NO: 495796 - DNA, 15 bp, Homo sapiens
tagaaattgctatta

SEQ ID NO: 495797 - DNA, 15 bp, Homo sapiens
agaaattgctattat

SEQ ID NO: 495798 - DNA, 15 bp, Homo sapiens
gaaattgctattatt

SEQ ID NO: 495799 - DNA, 15 bp, Homo sapiens
aaattgctattattt

SEQ ID NO: 495800 - DNA, 15 bp, Homo sapiens
aattgctattatttt

SEQ ID NO: 495801 - DNA, 15 bp, Homo sapiens
attgctattatttta

SEQ ID NO: 495802 - DNA, 15 bp, Homo sapiens
ttgctattattttag

SEQ ID NO: 495803 - DNA, 15 bp, Homo sapiens
tgctattattttaga

SEQ ID NO: 495804 - DNA, 15 bp, Homo sapiens
gctattattttagaa

SEQ ID NO: 495805 - DNA, 15 bp, Homo sapiens
ctattattttagaat

SEQ ID NO: 495806 - DNA, 15 bp, Homo sapiens
tattattttagaata

SEQ ID NO: 495807 - DNA, 15 bp, Homo sapiens
attattttagaatag

SEQ ID NO: 495808 - DNA, 15 bp, Homo sapiens
ttattttagaatagg

SEQ ID NO: 495809 - DNA, 15 bp, Homo sapiens
tattttagaataggt

SEQ ID NO: 495810 - DNA, 15 bp, Homo sapiens
attttagaataggtt

SEQ ID NO: 495811 - DNA, 15 bp, Homo sapiens
ttttagaataggttg

SEQ ID NO: 495812 - DNA, 15 bp, Homo sapiens
tttagaataggttgg

SEQ ID NO: 495813 - DNA, 15 bp, Homo sapiens
ttagaataggttggg

SEQ ID NO: 495814 - DNA, 15 bp, Homo sapiens
tagaataggttgggt

SEQ ID NO: 495815 - DNA, 15 bp, Homo sapiens
agaataggttgggtg

SEQ ID NO: 495816 - DNA, 15 bp, Homo sapiens
gaataggttgggtgg

SEQ ID NO: 495817 - DNA, 15 bp, Homo sapiens
aataggttgggtggg

SEQ ID NO: 495818 - DNA, 15 bp, Homo sapiens
ataggttgggtgggt

SEQ ID NO: 495819 - DNA, 15 bp, Homo sapiens
taggttgggtgggtt

SEQ ID NO: 495820 - DNA, 15 bp, Homo sapiens
aggttgggtgggttg

SEQ ID NO: 495821 - DNA, 15 bp, Homo sapiens
ggttgggtgggttgg

SEQ ID NO: 495822 - DNA, 15 bp, Homo sapiens
gttgggtgggttggg

SEQ ID NO: 495823 - DNA, 15 bp, Homo sapiens
ttgggtgggttgggg

SEQ ID NO: 495824 - DNA, 15 bp, Homo sapiens
tgggtgggttggggg

SEQ ID NO: 495825 - DNA, 15 bp, Homo sapiens
gggtgggttgggggg

SEQ ID NO: 495826 - DNA, 15 bp, Homo sapiens
ggtgggttggggggc

SEQ ID NO: 495827 - DNA, 15 bp, Homo sapiens
gtgggttggggggca

SEQ ID NO: 495828 - DNA, 15 bp, Homo sapiens
tgggttggggggcaa

SEQ ID NO: 495829 - DNA, 15 bp, Homo sapiens
gggttggggggcaag

SEQ ID NO: 495830 - DNA, 15 bp, Homo sapiens
ggttggggggcaagg

SEQ ID NO: 495831 - DNA, 15 bp, Homo sapiens
gttggggggcaaggg

SEQ ID NO: 495832 - DNA, 15 bp, Homo sapiens
ttggggggcaagggt

SEQ ID NO: 495833 - DNA, 15 bp, Homo sapiens
tggggggcaagggtg

SEQ ID NO: 495834 - DNA, 15 bp, Homo sapiens
ggggggcaagggtgt

SEQ ID NO: 495835 - DNA, 15 bp, Homo sapiens
gggggcaagggtgtc

SEQ ID NO: 495836 - DNA, 15 bp, Homo sapiens
ggggcaagggtgtct

SEQ ID NO: 495837 - DNA, 15 bp, Homo sapiens
gggcaagggtgtcta

SEQ ID NO: 495838 - DNA, 15 bp, Homo sapiens
ggcaagggtgtctat

SEQ ID NO: 495839 - DNA, 15 bp, Homo sapiens
gcaagggtgtctatt

SEQ ID NO: 495840 - DNA, 15 bp, Homo sapiens
caagggtgtctattt

SEQ ID NO: 495841 - DNA, 15 bp, Homo sapiens
aagggtgtctatttg

SEQ ID NO: 495842 - DNA, 15 bp, Homo sapiens
agggtgtctatttgc

SEQ ID NO: 495843 - DNA, 15 bp, Homo sapiens
gggtgtctatttgca

SEQ ID NO: 495844 - DNA, 15 bp, Homo sapiens
ggtgtctatttgcag

SEQ ID NO: 495845 - DNA, 15 bp, Homo sapiens
gtgtctatttgcagc

SEQ ID NO: 495846 - DNA, 15 bp, Homo sapiens
tgtctatttgcagca

SEQ ID NO: 495847 - DNA, 15 bp, Homo sapiens
gtctatttgcagcag

SEQ ID NO: 495848 - DNA, 15 bp, Homo sapiens
tctatttgcagcaga

SEQ ID NO: 495849 - DNA, 15 bp, Homo sapiens
ctatttgcagcagag

SEQ ID NO: 495850 - DNA, 15 bp, Homo sapiens
tatttgcagcagaga

SEQ ID NO: 495851 - DNA, 15 bp, Homo sapiens
atttgcagcagagat

SEQ ID NO: 495852 - DNA, 15 bp, Homo sapiens
tttgcagcagagata

SEQ ID NO: 495853 - DNA, 15 bp, Homo sapiens
ttgcagcagagatat

SEQ ID NO: 495854 - DNA, 15 bp, Homo sapiens
tgcagcagagatatt

SEQ ID NO: 495855 - DNA, 15 bp, Homo sapiens
gcagcagagatattt

SEQ ID NO: 495856 - DNA, 15 bp, Homo sapiens
cagcagagatatttt

SEQ ID NO: 495857 - DNA, 15 bp, Homo sapiens
agcagagatattttg

SEQ ID NO: 495858 - DNA, 15 bp, Homo sapiens
gcagagatattttga

SEQ ID NO: 495859 - DNA, 15 bp, Homo sapiens
cagagatattttgaa

SEQ ID NO: 495860 - DNA, 15 bp, Homo sapiens
agagatattttgaaa

SEQ ID NO: 495861 - DNA, 15 bp, Homo sapiens
gagatattttgaaaa

SEQ ID NO: 495862 - DNA, 15 bp, Homo sapiens
agatattttgaaaag

SEQ ID NO: 495863 - DNA, 15 bp, Homo sapiens
gatattttgaaaaga

SEQ ID NO: 495864 - DNA, 15 bp, Homo sapiens
atattttgaaaagaa

SEQ ID NO: 495865 - DNA, 15 bp, Homo sapiens
tattttgaaaagaag

SEQ ID NO: 495866 - DNA, 15 bp, Homo sapiens
attttgaaaagaaga

SEQ ID NO: 495867 - DNA, 15 bp, Homo sapiens
ttttgaaaagaagaa

SEQ ID NO: 495868 - DNA, 15 bp, Homo sapiens
tttgaaaagaagaaa

SEQ ID NO: 495869 - DNA, 15 bp, Homo sapiens
ttgaaaagaagaaaa

SEQ ID NO: 495870 - DNA, 15 bp, Homo sapiens
tgaaaagaagaaaat

SEQ ID NO: 495871 - DNA, 15 bp, Homo sapiens
gaaaagaagaaaatt

SEQ ID NO: 495872 - DNA, 15 bp, Homo sapiens
aaagaagaaaattgt

SEQ ID NO: 495873 - DNA, 15 bp, Homo sapiens
aagaagaaaattgtt

SEQ ID NO: 495874 - DNA, 15 bp, Homo sapiens
agaagaaaattgttt

SEQ ID NO: 495875 - DNA, 15 bp, Homo sapiens
gaagaaaattgtttt

SEQ ID NO: 495876 - DNA, 15 bp, Homo sapiens
aagaaaattgtttta

SEQ ID NO: 495877 - DNA, 15 bp, Homo sapiens
agaaaattgttttat

SEQ ID NO: 495878 - DNA, 15 bp, Homo sapiens
gaaaattgttttata

SEQ ID NO: 495879 - DNA, 15 bp, Homo sapiens
aaaattgttttatat

SEQ ID NO: 495880 - DNA, 15 bp, Homo sapiens
aaattgttttatata

SEQ ID NO: 495881 - DNA, 15 bp, Homo sapiens
aattgttttatataa

SEQ ID NO: 495882 - DNA, 15 bp, Homo sapiens
attgttttatataaa

SEQ ID NO: 495883 - DNA, 15 bp, Homo sapiens
ttgttttatataaaa

SEQ ID NO: 495884 - DNA, 15 bp, Homo sapiens
tgttttatataaaaa

SEQ ID NO: 495885 - DNA, 15 bp, Homo sapiens
gttttatataaaaag

SEQ ID NO: 495886 - DNA, 15 bp, Homo sapiens
ttttatataaaaagg

SEQ ID NO: 495887 - DNA, 15 bp, Homo sapiens
tttatataaaaagga

SEQ ID NO: 495888 - DNA, 15 bp, Homo sapiens
ttatataaaaaggaa

SEQ ID NO: 495889 - DNA, 15 bp, Homo sapiens
tatataaaaaggaaa

SEQ ID NO: 495890 - DNA, 15 bp, Homo sapiens
atataaaaaggaaag

SEQ ID NO: 495891 - DNA, 15 bp, Homo sapiens
tataaaaaggaaagc

SEQ ID NO: 495892 - DNA, 15 bp, Homo sapiens
ataaaaaggaaagcc

SEQ ID NO: 495893 - DNA, 15 bp, Homo sapiens
taaaaaggaaagcca

SEQ ID NO: 495894 - DNA, 15 bp, Homo sapiens
aaaaaggaaagccat

SEQ ID NO: 495895 - DNA, 15 bp, Homo sapiens
aaaaggaaagccatg

SEQ ID NO: 495896 - DNA, 15 bp, Homo sapiens
aaaggaaagccatga

SEQ ID NO: 495897 - DNA, 15 bp, Homo sapiens
aaggaaagccatgac

SEQ ID NO: 495898 - DNA, 15 bp, Homo sapiens
aggaaagccatgacc

SEQ ID NO: 495899 - DNA, 15 bp, Homo sapiens
ggaaagccatgacca

SEQ ID NO: 495900 - DNA, 15 bp, Homo sapiens
gaaagccatgaccac

SEQ ID NO: 495901 - DNA, 15 bp, Homo sapiens
aaagccatgaccacc

SEQ ID NO: 495902 - DNA, 15 bp, Homo sapiens
aagccatgaccacct

SEQ ID NO: 495903 - DNA, 15 bp, Homo sapiens
agccatgaccacctt

SEQ ID NO: 495904 - DNA, 15 bp, Homo sapiens
gccatgaccaccttt

SEQ ID NO: 495905 - DNA, 15 bp, Homo sapiens
ccatgaccacctttc

SEQ ID NO: 495906 - DNA, 15 bp, Homo sapiens
catgaccacctttct

SEQ ID NO: 495907 - DNA, 15 bp, Homo sapiens
atgaccacctttcta

SEQ ID NO: 495908 - DNA, 15 bp, Homo sapiens
tgaccacctttctac

SEQ ID NO: 495909 - DNA, 15 bp, Homo sapiens
gaccacctttctacc

SEQ ID NO: 495910 - DNA, 15 bp, Homo sapiens
accacctttctacct

SEQ ID NO: 495911 - DNA, 15 bp, Homo sapiens
ccacctttctacctc

SEQ ID NO: 495912 - DNA, 15 bp, Homo sapiens
cacctttctacctca

SEQ ID NO: 495913 - DNA, 15 bp, Homo sapiens
acctttctacctcag

SEQ ID NO: 495914 - DNA, 15 bp, Homo sapiens
cctttctacctcaga

SEQ ID NO: 495915 - DNA, 15 bp, Homo sapiens
ctttctacctcagat

SEQ ID NO: 495916 - DNA, 15 bp, Homo sapiens
tttctacctcagatc

SEQ ID NO: 495917 - DNA, 15 bp, Homo sapiens
ttctacctcagatcc

SEQ ID NO: 495918 - DNA, 15 bp, Homo sapiens
tctacctcagatcca

SEQ ID NO: 495919 - DNA, 15 bp, Homo sapiens
ctacctcagatccat

SEQ ID NO: 495920 - DNA, 15 bp, Homo sapiens
tacctcagatccatc

SEQ ID NO: 495921 - DNA, 15 bp, Homo sapiens
acctcagatccatct

SEQ ID NO: 495922 - DNA, 15 bp, Homo sapiens
cctcagatccatctt

SEQ ID NO: 495923 - DNA, 15 bp, Homo sapiens
ctcagatccatcttc

SEQ ID NO: 495924 - DNA, 15 bp, Homo sapiens
tcagatccatcttca

SEQ ID NO: 495925 - DNA, 15 bp, Homo sapiens
cagatccatcttcat

SEQ ID NO: 495926 - DNA, 15 bp, Homo sapiens
agatccatcttcatc

SEQ ID NO: 495927 - DNA, 15 bp, Homo sapiens
gatccatcttcatcc

SEQ ID NO: 495928 - DNA, 15 bp, Homo sapiens
atccatcttcatcca

SEQ ID NO: 495929 - DNA, 15 bp, Homo sapiens
tccatcttcatccat

SEQ ID NO: 495930 - DNA, 15 bp, Homo sapiens
ccatcttcatccatt

SEQ ID NO: 495931 - DNA, 15 bp, Homo sapiens
catcttcatccattg

SEQ ID NO: 495932 - DNA, 15 bp, Homo sapiens
atcttcatccattgc

SEQ ID NO: 495933 - DNA, 15 bp, Homo sapiens
tcttcatccattgca

SEQ ID NO: 495934 - DNA, 15 bp, Homo sapiens
cttcatccattgcat

SEQ ID NO: 495935 - DNA, 15 bp, Homo sapiens
ttcatccattgcatt

SEQ ID NO: 495936 - DNA, 15 bp, Homo sapiens
tcatccattgcattg

SEQ ID NO: 495937 - DNA, 15 bp, Homo sapiens
catccattgcattgg

SEQ ID NO: 495938 - DNA, 15 bp, Homo sapiens
atccattgcattgga

SEQ ID NO: 495939 - DNA, 15 bp, Homo sapiens
tccattgcattggaa

SEQ ID NO: 495940 - DNA, 15 bp, Homo sapiens
ccattgcattggaaa

SEQ ID NO: 495941 - DNA, 15 bp, Homo sapiens
cattgcattggaaac

SEQ ID NO: 495942 - DNA, 15 bp, Homo sapiens
attgcattggaaact

SEQ ID NO: 495943 - DNA, 15 bp, Homo sapiens
ttgcattggaaactg

SEQ ID NO: 495944 - DNA, 15 bp, Homo sapiens
tgcattggaaactgc

SEQ ID NO: 495945 - DNA, 15 bp, Homo sapiens
gcattggaaactgct

SEQ ID NO: 495946 - DNA, 15 bp, Homo sapiens
cattggaaactgctt

SEQ ID NO: 495947 - DNA, 15 bp, Homo sapiens
attggaaactgcttt

SEQ ID NO: 495948 - DNA, 15 bp, Homo sapiens
ttggaaactgcttta

SEQ ID NO: 495949 - DNA, 15 bp, Homo sapiens
tggaaactgctttat

SEQ ID NO: 495950 - DNA, 15 bp, Homo sapiens
ggaaactgctttatg

SEQ ID NO: 495951 - DNA, 15 bp, Homo sapiens
gaaactgctttatgc

SEQ ID NO: 495952 - DNA, 15 bp, Homo sapiens
aaactgctttatgct

SEQ ID NO: 495953 - DNA, 15 bp, Homo sapiens
aactgctttatgctg

SEQ ID NO: 495954 - DNA, 15 bp, Homo sapiens
actgctttatgctgc

SEQ ID NO: 495955 - DNA, 15 bp, Homo sapiens
ctgctttatgctgct

SEQ ID NO: 495956 - DNA, 15 bp, Homo sapiens
tgctttatgctgctg

SEQ ID NO: 495957 - DNA, 15 bp, Homo sapiens
gctttatgctgctgc

SEQ ID NO: 495958 - DNA, 15 bp, Homo sapiens
ctttatgctgctgca

SEQ ID NO: 495959 - DNA, 15 bp, Homo sapiens
tttatgctgctgcag

SEQ ID NO: 495960 - DNA, 15 bp, Homo sapiens
ttatgctgctgcagt

SEQ ID NO: 495961 - DNA, 15 bp, Homo sapiens
tatgctgctgcagtc

SEQ ID NO: 495962 - DNA, 15 bp, Homo sapiens
atgctgctgcagtct

SEQ ID NO: 495963 - DNA, 15 bp, Homo sapiens
tgctgctgcagtctg

SEQ ID NO: 495964 - DNA, 15 bp, Homo sapiens
gctgctgcagtctgc

SEQ ID NO: 495965 - DNA, 15 bp, Homo sapiens
ctgctgcagtctgca

SEQ ID NO: 495966 - DNA, 15 bp, Homo sapiens
tgctgcagtctgcaa

SEQ ID NO: 495967 - DNA, 15 bp, Homo sapiens
gctgcagtctgcaaa

SEQ ID NO: 495968 - DNA, 15 bp, Homo sapiens
ctgcagtctgcaaag

SEQ ID NO: 495969 - DNA, 15 bp, Homo sapiens
tgcagtctgcaaagt

SEQ ID NO: 495970 - DNA, 15 bp, Homo sapiens
gcagtctgcaaagtc

SEQ ID NO: 495971 - DNA, 15 bp, Homo sapiens
cagtctgcaaagtct

SEQ ID NO: 495972 - DNA, 15 bp, Homo sapiens
agtctgcaaagtcta

SEQ ID NO: 495973 - DNA, 15 bp, Homo sapiens
gtctgcaaagtctag

SEQ ID NO: 495974 - DNA, 15 bp, Homo sapiens
tctgcaaagtctaga

SEQ ID NO: 495975 - DNA, 15 bp, Homo sapiens
ctgcaaagtctagag

SEQ ID NO: 495976 - DNA, 15 bp, Homo sapiens
tgcaaagtctagagc

SEQ ID NO: 495977 - DNA, 15 bp, Homo sapiens
gcaaagtctagagct

SEQ ID NO: 495978 - DNA, 15 bp, Homo sapiens
caaagtctagagctt

SEQ ID NO: 495979 - DNA, 15 bp, Homo sapiens
aaagtctagagcttt

SEQ ID NO: 495980 - DNA, 15 bp, Homo sapiens
aagtctagagctttt

SEQ ID NO: 495981 - DNA, 15 bp, Homo sapiens
agtctagagctttta

SEQ ID NO: 495982 - DNA, 15 bp, Homo sapiens
gtctagagcttttat

SEQ ID NO: 495983 - DNA, 15 bp, Homo sapiens
tctagagcttttatc

SEQ ID NO: 495984 - DNA, 15 bp, Homo sapiens
ctagagcttttatca

SEQ ID NO: 495985 - DNA, 15 bp, Homo sapiens
tagagcttttatcag

SEQ ID NO: 495986 - DNA, 15 bp, Homo sapiens
agagcttttatcagg

SEQ ID NO: 495987 - DNA, 15 bp, Homo sapiens
gagcttttatcaggc

SEQ ID NO: 495988 - DNA, 15 bp, Homo sapiens
agcttttatcaggcc

SEQ ID NO: 495989 - DNA, 15 bp, Homo sapiens
gcttttatcaggcca

SEQ ID NO: 495990 - DNA, 15 bp, Homo sapiens
cttttatcaggccat

SEQ ID NO: 495991 - DNA, 15 bp, Homo sapiens
ttttatcaggccatg

SEQ ID NO: 495992 - DNA, 15 bp, Homo sapiens
tttatcaggccatgt

SEQ ID NO: 495993 - DNA, 15 bp, Homo sapiens
ttatcaggccatgtc

SEQ ID NO: 495994 - DNA, 15 bp, Homo sapiens
tatcaggccatgtca

SEQ ID NO: 495995 - DNA, 15 bp, Homo sapiens
atcaggccatgtcat

SEQ ID NO: 495996 - DNA, 15 bp, Homo sapiens
tcaggccatgtcata

SEQ ID NO: 495997 - DNA, 15 bp, Homo sapiens
caggccatgtcatac

SEQ ID NO: 495998 - DNA, 15 bp, Homo sapiens
aggccatgtcatacc

SEQ ID NO: 495999 - DNA, 15 bp, Homo sapiens
ggccatgtcataccc

SEQ ID NO: 496000 - DNA, 15 bp, Homo sapiens
gccatgtcataccca

SEQ ID NO: 496001 - DNA, 15 bp, Homo sapiens
ccatgtcatacccaa

SEQ ID NO: 496002 - DNA, 15 bp, Homo sapiens
catgtcatacccaag

SEQ ID NO: 496003 - DNA, 15 bp, Homo sapiens
atgtcatacccaaga

SEQ ID NO: 496004 - DNA, 15 bp, Homo sapiens
tgtcatacccaagaa

SEQ ID NO: 496005 - DNA, 15 bp, Homo sapiens
gtcatacccaagaaa

SEQ ID NO: 496006 - DNA, 15 bp, Homo sapiens
tcatacccaagaaag

SEQ ID NO: 496007 - DNA, 15 bp, Homo sapiens
catacccaagaaagc

SEQ ID NO: 496008 - DNA, 15 bp, Homo sapiens
atacccaagaaagca

SEQ ID NO: 496009 - DNA, 15 bp, Homo sapiens
tacccaagaaagcac

SEQ ID NO: 496010 - DNA, 15 bp, Homo sapiens
acccaagaaagcacc

SEQ ID NO: 496011 - DNA, 15 bp, Homo sapiens
cccaagaaagcacct

SEQ ID NO: 496012 - DNA, 15 bp, Homo sapiens
ccaagaaagcaccta

SEQ ID NO: 496013 - DNA, 15 bp, Homo sapiens
caagaaagcacctat

SEQ ID NO: 496014 - DNA, 15 bp, Homo sapiens
aagaaagcacctatt

SEQ ID NO: 496015 - DNA, 15 bp, Homo sapiens
agaaagcacctattt

SEQ ID NO: 496016 - DNA, 15 bp, Homo sapiens
gaaagcacctattta

SEQ ID NO: 496017 - DNA, 15 bp, Homo sapiens
aaagcacctatttaa

SEQ ID NO: 496018 - DNA, 15 bp, Homo sapiens
aagcacctatttaaa

SEQ ID NO: 496019 - DNA, 15 bp, Homo sapiens
agcacctatttaaag

SEQ ID NO: 496020 - DNA, 15 bp, Homo sapiens
gcacctatttaaaga

SEQ ID NO: 496021 - DNA, 15 bp, Homo sapiens
cacctatttaaagaa

SEQ ID NO: 496022 - DNA, 15 bp, Homo sapiens
acctatttaaagaaa

SEQ ID NO: 496023 - DNA, 15 bp, Homo sapiens
cctatttaaagaaaa

SEQ ID NO: 496024 - DNA, 15 bp, Homo sapiens
ctatttaaagaaaaa

SEQ ID NO: 496025 - DNA, 15 bp, Homo sapiens
tatttaaagaaaaaa

SEQ ID NO: 496026 - DNA, 15 bp, Homo sapiens
atttaaagaaaaaac

SEQ ID NO: 496027 - DNA, 15 bp, Homo sapiens
tttaaagaaaaaaca

SEQ ID NO: 496028 - DNA, 15 bp, Homo sapiens
ttaaagaaaaaacaa

SEQ ID NO: 496029 - DNA, 15 bp, Homo sapiens
taaagaaaaaacaat

SEQ ID NO: 496030 - DNA, 15 bp, Homo sapiens
aaagaaaaaacaatt

SEQ ID NO: 496031 - DNA, 15 bp, Homo sapiens
aagaaaaaacaattc

SEQ ID NO: 496032 - DNA, 15 bp, Homo sapiens
agaaaaaacaattcc

SEQ ID NO: 496033 - DNA, 15 bp, Homo sapiens
gaaaaaacaattccc

SEQ ID NO: 496034 - DNA, 15 bp, Homo sapiens
aaaaaacaattccct

SEQ ID NO: 496035 - DNA, 15 bp, Homo sapiens
aaaaacaattccctg

SEQ ID NO: 496036 - DNA, 15 bp, Homo sapiens
aaaacaattccctga

SEQ ID NO: 496037 - DNA, 15 bp, Homo sapiens
aaacaattccctgag

SEQ ID NO: 496038 - DNA, 15 bp, Homo sapiens
aacaattccctgagc

SEQ ID NO: 496039 - DNA, 15 bp, Homo sapiens
acaattccctgagct

SEQ ID NO: 496040 - DNA, 15 bp, Homo sapiens
caattccctgagctc

SEQ ID NO: 496041 - DNA, 15 bp, Homo sapiens
aattccctgagctct

SEQ ID NO: 496042 - DNA, 15 bp, Homo sapiens
attccctgagctctc

SEQ ID NO: 496043 - DNA, 15 bp, Homo sapiens
ttccctgagctctca

SEQ ID NO: 496044 - DNA, 15 bp, Homo sapiens
tccctgagctctcaa

SEQ ID NO: 496045 - DNA, 15 bp, Homo sapiens
ccctgagctctcaac

SEQ ID NO: 496046 - DNA, 15 bp, Homo sapiens
cctgagctctcaact

SEQ ID NO: 496047 - DNA, 15 bp, Homo sapiens
ctgagctctcaactc

SEQ ID NO: 496048 - DNA, 15 bp, Homo sapiens
tgagctctcaactcc

SEQ ID NO: 496049 - DNA, 15 bp, Homo sapiens
gagctctcaactcca

SEQ ID NO: 496050 - DNA, 15 bp, Homo sapiens
agctctcaactccaa

SEQ ID NO: 496051 - DNA, 15 bp, Homo sapiens
gctctcaactccaag

SEQ ID NO: 496052 - DNA, 15 bp, Homo sapiens
ctctcaactccaagt

SEQ ID NO: 496053 - DNA, 15 bp, Homo sapiens
tctcaactccaagtt

SEQ ID NO: 496054 - DNA, 15 bp, Homo sapiens
ctcaactccaagttg

SEQ ID NO: 496055 - DNA, 15 bp, Homo sapiens
tcaactccaagttgt

SEQ ID NO: 496056 - DNA, 15 bp, Homo sapiens
caactccaagttgta

SEQ ID NO: 496057 - DNA, 15 bp, Homo sapiens
aactccaagttgtag

SEQ ID NO: 496058 - DNA, 15 bp, Homo sapiens
actccaagttgtaga

SEQ ID NO: 496059 - DNA, 15 bp, Homo sapiens
ctccaagttgtagat

SEQ ID NO: 496060 - DNA, 15 bp, Homo sapiens
tccaagttgtagatt

SEQ ID NO: 496061 - DNA, 15 bp, Homo sapiens
ccaagttgtagattt

SEQ ID NO: 496062 - DNA, 15 bp, Homo sapiens
caagttgtagatttg

SEQ ID NO: 496063 - DNA, 15 bp, Homo sapiens
aagttgtagatttgg

SEQ ID NO: 496064 - DNA, 15 bp, Homo sapiens
agttgtagatttggt

SEQ ID NO: 496065 - DNA, 15 bp, Homo sapiens
gttgtagatttggtg

SEQ ID NO: 496066 - DNA, 15 bp, Homo sapiens
ttgtagatttggtgt

SEQ ID NO: 496067 - DNA, 15 bp, Homo sapiens
tgtagatttggtgtc

SEQ ID NO: 496068 - DNA, 15 bp, Homo sapiens
tagatttggtgtctt

SEQ ID NO: 496069 - DNA, 15 bp, Homo sapiens
agatttggtgtcttc

SEQ ID NO: 496070 - DNA, 15 bp, Homo sapiens
gatttggtgtcttcc

SEQ ID NO: 496071 - DNA, 15 bp, Homo sapiens
atttggtgtcttcct

SEQ ID NO: 496072 - DNA, 15 bp, Homo sapiens
tttggtgtcttcctt

SEQ ID NO: 496073 - DNA, 15 bp, Homo sapiens
ttggtgtcttccttg

SEQ ID NO: 496074 - DNA, 15 bp, Homo sapiens
tggtgtcttccttgt

SEQ ID NO: 496075 - DNA, 15 bp, Homo sapiens
ggtgtcttccttgtt

SEQ ID NO: 496076 - DNA, 15 bp, Homo sapiens
gtgtcttccttgttc

SEQ ID NO: 496077 - DNA, 15 bp, Homo sapiens
tgtcttccttgttct

SEQ ID NO: 496078 - DNA, 15 bp, Homo sapiens
gtcttccttgttctt

SEQ ID NO: 496079 - DNA, 15 bp, Homo sapiens
tcttccttgttctta

SEQ ID NO: 496080 - DNA, 15 bp, Homo sapiens
cttccttgttcttac

SEQ ID NO: 496081 - DNA, 15 bp, Homo sapiens
ttccttgttcttact

SEQ ID NO: 496082 - DNA, 15 bp, Homo sapiens
tccttgttcttactt

SEQ ID NO: 496083 - DNA, 15 bp, Homo sapiens
ccttgttcttacttt

SEQ ID NO: 496084 - DNA, 15 bp, Homo sapiens
cttgttcttacttta

SEQ ID NO: 496085 - DNA, 15 bp, Homo sapiens
ttgttcttactttaa

SEQ ID NO: 496086 - DNA, 15 bp, Homo sapiens
tgttcttactttaaa

SEQ ID NO: 496087 - DNA, 15 bp, Homo sapiens
gttcttactttaaaa

SEQ ID NO: 496088 - DNA, 15 bp, Homo sapiens
ttcttactttaaaaa

SEQ ID NO: 496089 - DNA, 15 bp, Homo sapiens
tcttactttaaaaag

SEQ ID NO: 496090 - DNA, 15 bp, Homo sapiens
cttactttaaaaagt

SEQ ID NO: 496091 - DNA, 15 bp, Homo sapiens
ttactttaaaaagtc

SEQ ID NO: 496092 - DNA, 15 bp, Homo sapiens
actttaaaaagtcat

SEQ ID NO: 496093 - DNA, 15 bp, Homo sapiens
ctttaaaaagtcatg

SEQ ID NO: 496094 - DNA, 15 bp, Homo sapiens
tttaaaaagtcatgt

SEQ ID NO: 496095 - DNA, 15 bp, Homo sapiens
ttaaaaagtcatgtg

SEQ ID NO: 496096 - DNA, 15 bp, Homo sapiens
taaaaagtcatgtgt

SEQ ID NO: 496097 - DNA, 15 bp, Homo sapiens
aaaaagtcatgtgtt

SEQ ID NO: 496098 - DNA, 15 bp, Homo sapiens
aaaagtcatgtgtta

SEQ ID NO: 496099 - DNA, 15 bp, Homo sapiens
aaagtcatgtgttaa

SEQ ID NO: 496100 - DNA, 15 bp, Homo sapiens
aagtcatgtgttaat

SEQ ID NO: 496101 - DNA, 15 bp, Homo sapiens
agtcatgtgttaatt

SEQ ID NO: 496102 - DNA, 15 bp, Homo sapiens
gtcatgtgttaattt

SEQ ID NO: 496103 - DNA, 15 bp, Homo sapiens
tcatgtgttaatttt

SEQ ID NO: 496104 - DNA, 15 bp, Homo sapiens
catgtgttaattttt

SEQ ID NO: 496105 - DNA, 15 bp, Homo sapiens
atgtgttaatttttt

SEQ ID NO: 496106 - DNA, 15 bp, Homo sapiens
tgtgttaattttttt

SEQ ID NO: 496107 - DNA, 15 bp, Homo sapiens
gtgttaatttttttt

SEQ ID NO: 496108 - DNA, 15 bp, Homo sapiens
tgttaattttttttc

SEQ ID NO: 496109 - DNA, 15 bp, Homo sapiens
gttaattttttttct

SEQ ID NO: 496110 - DNA, 15 bp, Homo sapiens
taattttttttctgc

SEQ ID NO: 496111 - DNA, 15 bp, Homo sapiens
aattttttttctgcc

SEQ ID NO: 496112 - DNA, 15 bp, Homo sapiens
attttttttctgcct

SEQ ID NO: 496113 - DNA, 15 bp, Homo sapiens
ttttttttctgcctg

SEQ ID NO: 496114 - DNA, 15 bp, Homo sapiens
tttttttctgcctgt

SEQ ID NO: 496115 - DNA, 15 bp, Homo sapiens
ttttttctgcctgta

SEQ ID NO: 496116 - DNA, 15 bp, Homo sapiens
tttttctgcctgtat

SEQ ID NO: 496117 - DNA, 15 bp, Homo sapiens
ttttctgcctgtatt

SEQ ID NO: 496118 - DNA, 15 bp, Homo sapiens
tttctgcctgtattt

SEQ ID NO: 496119 - DNA, 15 bp, Homo sapiens
ttctgcctgtatttg

SEQ ID NO: 496120 - DNA, 15 bp, Homo sapiens
tctgcctgtatttgt

SEQ ID NO: 496121 - DNA, 15 bp, Homo sapiens
ctgcctgtatttgta

SEQ ID NO: 496122 - DNA, 15 bp, Homo sapiens
tgcctgtatttgtat

SEQ ID NO: 496123 - DNA, 15 bp, Homo sapiens
gcctgtatttgtatg

SEQ ID NO: 496124 - DNA, 15 bp, Homo sapiens
cctgtatttgtatgc

SEQ ID NO: 496125 - DNA, 15 bp, Homo sapiens
ctgtatttgtatgca

SEQ ID NO: 496126 - DNA, 15 bp, Homo sapiens
tgtatttgtatgcaa

SEQ ID NO: 496127 - DNA, 15 bp, Homo sapiens
gtatttgtatgcaaa

SEQ ID NO: 496128 - DNA, 15 bp, Homo sapiens
tatttgtatgcaaaa

SEQ ID NO: 496129 - DNA, 15 bp, Homo sapiens
atttgtatgcaaaat

SEQ ID NO: 496130 - DNA, 15 bp, Homo sapiens
tttgtatgcaaaatg

SEQ ID NO: 496131 - DNA, 15 bp, Homo sapiens
ttgtatgcaaaatgt

SEQ ID NO: 496132 - DNA, 15 bp, Homo sapiens
tgtatgcaaaatgtc

SEQ ID NO: 496133 - DNA, 15 bp, Homo sapiens
gtatgcaaaatgtcc

SEQ ID NO: 496134 - DNA, 15 bp, Homo sapiens
tatgcaaaatgtcct

SEQ ID NO: 496135 - DNA, 15 bp, Homo sapiens
atgcaaaatgtcctc

SEQ ID NO: 496136 - DNA, 15 bp, Homo sapiens
tgcaaaatgtcctct

SEQ ID NO: 496137 - DNA, 15 bp, Homo sapiens
gcaaaatgtcctcta

SEQ ID NO: 496138 - DNA, 15 bp, Homo sapiens
caaaatgtcctctat

SEQ ID NO: 496139 - DNA, 15 bp, Homo sapiens
aaaatgtcctctatc

SEQ ID NO: 496140 - DNA, 15 bp, Homo sapiens
aaatgtcctctatct

SEQ ID NO: 496141 - DNA, 15 bp, Homo sapiens
aatgtcctctatctg

SEQ ID NO: 496142 - DNA, 15 bp, Homo sapiens
atgtcctctatctgc

SEQ ID NO: 496143 - DNA, 15 bp, Homo sapiens
tgtcctctatctgct

SEQ ID NO: 496144 - DNA, 15 bp, Homo sapiens
gtcctctatctgcta

SEQ ID NO: 496145 - DNA, 15 bp, Homo sapiens
tcctctatctgctat

SEQ ID NO: 496146 - DNA, 15 bp, Homo sapiens
cctctatctgctatt

SEQ ID NO: 496147 - DNA, 15 bp, Homo sapiens
ctctatctgctatta

SEQ ID NO: 496148 - DNA, 15 bp, Homo sapiens
tctatctgctattaa

SEQ ID NO: 496149 - DNA, 15 bp, Homo sapiens
ctatctgctattaaa

SEQ ID NO: 496150 - DNA, 15 bp, Homo sapiens
tatctgctattaaag

SEQ ID NO: 496151 - DNA, 15 bp, Homo sapiens
atctgctattaaaga

SEQ ID NO: 496152 - DNA, 15 bp, Homo sapiens
tctgctattaaagaa

SEQ ID NO: 496153 - DNA, 15 bp, Homo sapiens
ctgctattaaagaaa

SEQ ID NO: 496154 - DNA, 15 bp, Homo sapiens
tgctattaaagaaaa

SEQ ID NO: 496155 - DNA, 15 bp, Homo sapiens
gctattaaagaaaag

SEQ ID NO: 496156 - DNA, 15 bp, Homo sapiens
ctattaaagaaaagc

SEQ ID NO: 496157 - DNA, 15 bp, Homo sapiens
tattaaagaaaagct

SEQ ID NO: 496158 - DNA, 15 bp, Homo sapiens
attaaagaaaagcta

SEQ ID NO: 496159 - DNA, 15 bp, Homo sapiens
ttaaagaaaagctac

SEQ ID NO: 496160 - DNA, 15 bp, Homo sapiens
taaagaaaagctacg

SEQ ID NO: 496161 - DNA, 15 bp, Homo sapiens
aaagaaaagctacgt

SEQ ID NO: 496162 - DNA, 15 bp, Homo sapiens
aagaaaagctacgta

SEQ ID NO: 496163 - DNA, 15 bp, Homo sapiens
agaaaagctacgtaa

SEQ ID NO: 496164 - DNA, 15 bp, Homo sapiens
gaaaagctacgtaaa

SEQ ID NO: 496165 - DNA, 15 bp, Homo sapiens
aaaagctacgtaaaa

SEQ ID NO: 496166 - DNA, 15 bp, Homo sapiens
aaagctacgtaaaac

SEQ ID NO: 496167 - DNA, 15 bp, Homo sapiens
aagctacgtaaaaca

SEQ ID NO: 496168 - DNA, 15 bp, Homo sapiens
agctacgtaaaacac

SEQ ID NO: 496169 - DNA, 15 bp, Homo sapiens
gctacgtaaaacact

SEQ ID NO: 496170 - DNA, 15 bp, Homo sapiens
ctacgtaaaacacta

SEQ ID NO: 496171 - DNA, 15 bp, Homo sapiens
tacgtaaaacactac

SEQ ID NO: 496172 - DNA, 15 bp, Homo sapiens
acgtaaaacactaca

SEQ ID NO: 496173 - DNA, 15 bp, Homo sapiens
cgtaaaacactacat

SEQ ID NO: 496174 - DNA, 15 bp, Homo sapiens
gtaaaacactacatt

SEQ ID NO: 496175 - DNA, 15 bp, Homo sapiens
taaaacactacattg

SEQ ID NO: 496176 - DNA, 15 bp, Homo sapiens
aaaacactacattgt

SEQ ID NO: 496177 - DNA, 15 bp, Homo sapiens
aaacactacattgta

SEQ ID NO: 496178 - DNA, 15 bp, Homo sapiens
aacactacattgtaa

SEQ ID NO: 496179 - DNA, 15 bp, Homo sapiens
acactacattgtaac

SEQ ID NO: 496180 - DNA, 15 bp, Homo sapiens
cactacattgtaacc

SEQ ID NO: 496181 - DNA, 15 bp, Homo sapiens
actacattgtaacct

SEQ ID NO: 496182 - DNA, 15 bp, Homo sapiens
ctacattgtaacctt

SEQ ID NO: 496183 - DNA, 15 bp, Homo sapiens
tacattgtaaccttc

SEQ ID NO: 496184 - DNA, 15 bp, Homo sapiens
acattgtaaccttct

SEQ ID NO: 496185 - DNA, 15 bp, Homo sapiens
cattgtaaccttcta

SEQ ID NO: 496186 - DNA, 15 bp, Homo sapiens
attgtaaccttctaa

SEQ ID NO: 496187 - DNA, 15 bp, Homo sapiens
ttgtaaccttctaag

SEQ ID NO: 496188 - DNA, 15 bp, Homo sapiens
tgtaaccttctaagt

SEQ ID NO: 496189 - DNA, 15 bp, Homo sapiens
gtaaccttctaagta

SEQ ID NO: 496190 - DNA, 15 bp, Homo sapiens
taaccttctaagtaa

SEQ ID NO: 496191 - DNA, 15 bp, Homo sapiens
aaccttctaagtaat

SEQ ID NO: 496192 - DNA, 15 bp, Homo sapiens
accttctaagtaata

SEQ ID NO: 496193 - DNA, 15 bp, Homo sapiens
ccttctaagtaataa

SEQ ID NO: 496194 - DNA, 15 bp, Homo sapiens
cttctaagtaataat

SEQ ID NO: 496195 - DNA, 15 bp, Homo sapiens
ttctaagtaataata

SEQ ID NO: 496196 - DNA, 15 bp, Homo sapiens
tctaagtaataataa

SEQ ID NO: 496197 - DNA, 15 bp, Homo sapiens
ctaagtaataataaa

SEQ ID NO: 496198 - DNA, 15 bp, Homo sapiens
taagtaataataaat

SEQ ID NO: 496199 - DNA, 15 bp, Homo sapiens
aagtaataataaata

SEQ ID NO: 496200 - DNA, 15 bp, Homo sapiens
agtaataataaataa

SEQ ID NO: 496201 - DNA, 15 bp, Homo sapiens
gtaataataaataaa

SEQ ID NO: 496202 - DNA, 15 bp, Homo sapiens
aataataaataaaaa

SEQ ID NO: 496203 - DNA, 15 bp, Homo sapiens
ataataaataaaaag

SEQ ID NO: 496204 - DNA, 15 bp, Homo sapiens
taataaataaaaaga

SEQ ID NO: 496205 - DNA, 15 bp, Homo sapiens
aataaataaaaagaa

SEQ ID NO: 496206 - DNA, 15 bp, Homo sapiens
ataaataaaaagaaa

SEQ ID NO: 496207 - DNA, 15 bp, Homo sapiens
taaataaaaagaaat

SEQ ID NO: 496208 - DNA, 15 bp, Homo sapiens
aaataaaaagaaata

SEQ ID NO: 496209 - DNA, 15 bp, Homo sapiens
aataaaaagaaatat

SEQ ID NO: 496210 - DNA, 15 bp, Homo sapiens
ataaaaagaaatata

SEQ ID NO: 496211 - DNA, 15 bp, Homo sapiens
taaaaagaaatatat

SEQ ID NO: 496212 - DNA, 15 bp, Homo sapiens
aaaaagaaatatatt

SEQ ID NO: 496213 - DNA, 15 bp, Homo sapiens
aaaagaaatatattg

SEQ ID NO: 496214 - DNA, 15 bp, Homo sapiens
aaagaaatatattgc

SEQ ID NO: 496215 - DNA, 15 bp, Homo sapiens
aagaaatatattgca

SEQ ID NO: 496216 - DNA, 15 bp, Homo sapiens
agaaatatattgcag

SEQ ID NO: 496217 - DNA, 15 bp, Homo sapiens
gaaatatattgcagt

SEQ ID NO: 496218 - DNA, 15 bp, Homo sapiens
aaatatattgcagta

SEQ ID NO: 496219 - DNA, 15 bp, Homo sapiens
aatatattgcagtaa

SEQ ID NO: 496220 - DNA, 15 bp, Homo sapiens
atatattgcagtaac

SEQ ID NO: 496221 - DNA, 15 bp, Homo sapiens
tatattgcagtaaca

SEQ ID NO: 496222 - DNA, 15 bp, Homo sapiens
atattgcagtaacaa

SEQ ID NO: 496223 - DNA, 15 bp, Homo sapiens
tattgcagtaacaat

SEQ ID NO: 496224 - DNA, 15 bp, Homo sapiens
attgcagtaacaatg

SEQ ID NO: 496225 - DNA, 15 bp, Homo sapiens
ttgcagtaacaatgg

SEQ ID NO: 496226 - DNA, 15 bp, Homo sapiens
tgcagtaacaatggg

SEQ ID NO: 496227 - DNA, 15 bp, Homo sapiens
gcagtaacaatggga

SEQ ID NO: 496228 - DNA, 15 bp, Homo sapiens
cagtaacaatgggaa

SEQ ID NO: 496229 - DNA, 15 bp, Homo sapiens
agtaacaatgggaag

SEQ ID NO: 496230 - DNA, 15 bp, Homo sapiens
gtaacaatgggaagt

SEQ ID NO: 496231 - DNA, 15 bp, Homo sapiens
taacaatgggaagta

SEQ ID NO: 496232 - DNA, 15 bp, Homo sapiens
aacaatgggaagtaa

SEQ ID NO: 496233 - DNA, 15 bp, Homo sapiens
acaatgggaagtaag

SEQ ID NO: 496234 - DNA, 15 bp, Homo sapiens
caatgggaagtaagt

SEQ ID NO: 496235 - DNA, 15 bp, Homo sapiens
aatgggaagtaagta

SEQ ID NO: 496236 - DNA, 15 bp, Homo sapiens
atgggaagtaagtat

SEQ ID NO: 496237 - DNA, 15 bp, Homo sapiens
tgggaagtaagtatg

SEQ ID NO: 496238 - DNA, 15 bp, Homo sapiens
gggaagtaagtatgt

SEQ ID NO: 496239 - DNA, 15 bp, Homo sapiens
ggaagtaagtatgta

SEQ ID NO: 496240 - DNA, 15 bp, Homo sapiens
gaagtaagtatgtag

SEQ ID NO: 496241 - DNA, 15 bp, Homo sapiens
aagtaagtatgtagt

SEQ ID NO: 496242 - DNA, 15 bp, Homo sapiens
agtaagtatgtagtt

SEQ ID NO: 496243 - DNA, 15 bp, Homo sapiens
gtaagtatgtagttc

SEQ ID NO: 496244 - DNA, 15 bp, Homo sapiens
taagtatgtagttct

SEQ ID NO: 496245 - DNA, 15 bp, Homo sapiens
aagtatgtagttctt

SEQ ID NO: 496246 - DNA, 15 bp, Homo sapiens
agtatgtagttcttt

SEQ ID NO: 496247 - DNA, 15 bp, Homo sapiens
gtatgtagttctttt

SEQ ID NO: 496248 - DNA, 15 bp, Homo sapiens
tatgtagttcttttg

SEQ ID NO: 496249 - DNA, 15 bp, Homo sapiens
atgtagttcttttga

SEQ ID NO: 496250 - DNA, 15 bp, Homo sapiens
tgtagttcttttgaa

SEQ ID NO: 496251 - DNA, 15 bp, Homo sapiens
gtagttcttttgaaa

SEQ ID NO: 496252 - DNA, 15 bp, Homo sapiens
tagttcttttgaaat

SEQ ID NO: 496253 - DNA, 15 bp, Homo sapiens
agttcttttgaaata

SEQ ID NO: 496254 - DNA, 15 bp, Homo sapiens
gttcttttgaaatat

SEQ ID NO: 496255 - DNA, 15 bp, Homo sapiens
ttcttttgaaatatg

SEQ ID NO: 496256 - DNA, 15 bp, Homo sapiens
tcttttgaaatatgt

SEQ ID NO: 496257 - DNA, 15 bp, Homo sapiens
cttttgaaatatgtg

SEQ ID NO: 496258 - DNA, 15 bp, Homo sapiens
ttttgaaatatgtgg

SEQ ID NO: 496259 - DNA, 15 bp, Homo sapiens
tttgaaatatgtggt

SEQ ID NO: 496260 - DNA, 15 bp, Homo sapiens
ttgaaatatgtggta

SEQ ID NO: 496261 - DNA, 15 bp, Homo sapiens
tgaaatatgtggtaa

SEQ ID NO: 496262 - DNA, 15 bp, Homo sapiens
gaaatatgtggtaaa

SEQ ID NO: 496263 - DNA, 15 bp, Homo sapiens
aaatatgtggtaaag

SEQ ID NO: 496264 - DNA, 15 bp, Homo sapiens
aatatgtggtaaaga

SEQ ID NO: 496265 - DNA, 15 bp, Homo sapiens
atatgtggtaaagaa

SEQ ID NO: 496266 - DNA, 15 bp, Homo sapiens
tatgtggtaaagaac

SEQ ID NO: 496267 - DNA, 15 bp, Homo sapiens
atgtggtaaagaact

SEQ ID NO: 496268 - DNA, 15 bp, Homo sapiens
tgtggtaaagaacta

SEQ ID NO: 496269 - DNA, 15 bp, Homo sapiens
gtggtaaagaactaa

SEQ ID NO: 496270 - DNA, 15 bp, Homo sapiens
tggtaaagaactaat

SEQ ID NO: 496271 - DNA, 15 bp, Homo sapiens
ggtaaagaactaatc

SEQ ID NO: 496272 - DNA, 15 bp, Homo sapiens
gtaaagaactaatca

SEQ ID NO: 496273 - DNA, 15 bp, Homo sapiens
taaagaactaatcac

SEQ ID NO: 496274 - DNA, 15 bp, Homo sapiens
aaagaactaatcaca

SEQ ID NO: 496275 - DNA, 15 bp, Homo sapiens
aagaactaatcacag

SEQ ID NO: 496276 - DNA, 15 bp, Homo sapiens
agaactaatcacaga

SEQ ID NO: 496277 - DNA, 15 bp, Homo sapiens
gaactaatcacagac

SEQ ID NO: 496278 - DNA, 15 bp, Homo sapiens
aactaatcacagact

SEQ ID NO: 496279 - DNA, 15 bp, Homo sapiens
actaatcacagacta

SEQ ID NO: 496280 - DNA, 15 bp, Homo sapiens
ctaatcacagactat

SEQ ID NO: 496281 - DNA, 15 bp, Homo sapiens
taatcacagactatc

SEQ ID NO: 496282 - DNA, 15 bp, Homo sapiens
aatcacagactatca

SEQ ID NO: 496283 - DNA, 15 bp, Homo sapiens
atcacagactatcat

SEQ ID NO: 496284 - DNA, 15 bp, Homo sapiens
tcacagactatcatc

SEQ ID NO: 496285 - DNA, 15 bp, Homo sapiens
cacagactatcatct

SEQ ID NO: 496286 - DNA, 15 bp, Homo sapiens
acagactatcatcta

SEQ ID NO: 496287 - DNA, 15 bp, Homo sapiens
cagactatcatctaa

SEQ ID NO: 496288 - DNA, 15 bp, Homo sapiens
agactatcatctaat

SEQ ID NO: 496289 - DNA, 15 bp, Homo sapiens
gactatcatctaatc

SEQ ID NO: 496290 - DNA, 15 bp, Homo sapiens
actatcatctaatct

SEQ ID NO: 496291 - DNA, 15 bp, Homo sapiens
ctatcatctaatctg

SEQ ID NO: 496292 - DNA, 15 bp, Homo sapiens
tatcatctaatctgg

SEQ ID NO: 496293 - DNA, 15 bp, Homo sapiens
atcatctaatctggt

SEQ ID NO: 496294 - DNA, 15 bp, Homo sapiens
tcatctaatctggtt

SEQ ID NO: 496295 - DNA, 15 bp, Homo sapiens
catctaatctggtta

SEQ ID NO: 496296 - DNA, 15 bp, Homo sapiens
atctaatctggttac

SEQ ID NO: 496297 - DNA, 15 bp, Homo sapiens
tctaatctggttaca

SEQ ID NO: 496298 - DNA, 15 bp, Homo sapiens
ctaatctggttacat

SEQ ID NO: 496299 - DNA, 15 bp, Homo sapiens
taatctggttacata

SEQ ID NO: 496300 - DNA, 15 bp, Homo sapiens
aatctggttacatat

SEQ ID NO: 496301 - DNA, 15 bp, Homo sapiens
atctggttacatatt

SEQ ID NO: 496302 - DNA, 15 bp, Homo sapiens
tctggttacatattg

SEQ ID NO: 496303 - DNA, 15 bp, Homo sapiens
ctggttacatattgt

SEQ ID NO: 496304 - DNA, 15 bp, Homo sapiens
tggttacatattgta

SEQ ID NO: 496305 - DNA, 15 bp, Homo sapiens
ggttacatattgtat

SEQ ID NO: 496306 - DNA, 15 bp, Homo sapiens
gttacatattgtatt

SEQ ID NO: 496307 - DNA, 15 bp, Homo sapiens
ttacatattgtattt

SEQ ID NO: 496308 - DNA, 15 bp, Homo sapiens
tacatattgtatttt

SEQ ID NO: 496309 - DNA, 15 bp, Homo sapiens
acatattgtattttt

SEQ ID NO: 496310 - DNA, 15 bp, Homo sapiens
catattgtatttttc

SEQ ID NO: 496311 - DNA, 15 bp, Homo sapiens
atattgtatttttca

SEQ ID NO: 496312 - DNA, 15 bp, Homo sapiens
tattgtatttttcat

SEQ ID NO: 496313 - DNA, 15 bp, Homo sapiens
attgtatttttcatc

SEQ ID NO: 496314 - DNA, 15 bp, Homo sapiens
ttgtatttttcatcc

SEQ ID NO: 496315 - DNA, 15 bp, Homo sapiens
tgtatttttcatcct

SEQ ID NO: 496316 - DNA, 15 bp, Homo sapiens
gtatttttcatcctg

SEQ ID NO: 496317 - DNA, 15 bp, Homo sapiens
tatttttcatcctga

SEQ ID NO: 496318 - DNA, 15 bp, Homo sapiens
atttttcatcctgaa

SEQ ID NO: 496319 - DNA, 15 bp, Homo sapiens
tttttcatcctgaat

SEQ ID NO: 496320 - DNA, 15 bp, Homo sapiens
ttttcatcctgaata

SEQ ID NO: 496321 - DNA, 15 bp, Homo sapiens
tttcatcctgaataa

SEQ ID NO: 496322 - DNA, 15 bp, Homo sapiens
ttcatcctgaataaa

SEQ ID NO: 496323 - DNA, 15 bp, Homo sapiens
tcatcctgaataaaa

SEQ ID NO: 496324 - DNA, 15 bp, Homo sapiens
catcctgaataaaag

SEQ ID NO: 496325 - DNA, 15 bp, Homo sapiens
atcctgaataaaagt

SEQ ID NO: 496326 - DNA, 15 bp, Homo sapiens
tcctgaataaaagta

SEQ ID NO: 496327 - DNA, 15 bp, Homo sapiens
cctgaataaaagtaa

SEQ ID NO: 496328 - DNA, 15 bp, Homo sapiens
ctgaataaaagtaat

SEQ ID NO: 496329 - DNA, 15 bp, Homo sapiens
tgaataaaagtaatt

SEQ ID NO: 496330 - DNA, 15 bp, Homo sapiens
gaataaaagtaattt

SEQ ID NO: 496331 - DNA, 15 bp, Homo sapiens
aataaaagtaatttt

SEQ ID NO: 496332 - DNA, 15 bp, Homo sapiens
ataaaagtaatttta

SEQ ID NO: 496333 - DNA, 15 bp, Homo sapiens
taaaagtaattttaa

SEQ ID NO: 496334 - DNA, 15 bp, Homo sapiens
aaaagtaattttaac

SEQ ID NO: 496335 - DNA, 15 bp, Homo sapiens
aaagtaattttaaca

SEQ ID NO: 496336 - DNA, 15 bp, Homo sapiens
aagtaattttaacac

SEQ ID NO: 496337 - DNA, 15 bp, Homo sapiens
agtaattttaacaca

SEQ ID NO: 496338 - DNA, 15 bp, Homo sapiens
gtaattttaacacaa

SEQ ID NO: 496339 - DNA, 15 bp, Homo sapiens
taattttaacacaag

SEQ ID NO: 496340 - DNA, 15 bp, Homo sapiens
aattttaacacaaga

SEQ ID NO: 496341 - DNA, 15 bp, Homo sapiens
attttaacacaagat

SEQ ID NO: 496342 - DNA, 15 bp, Homo sapiens
ttttaacacaagatg

SEQ ID NO: 496343 - DNA, 15 bp, Homo sapiens
tttaacacaagatga

SEQ ID NO: 496344 - DNA, 15 bp, Homo sapiens
ttaacacaagatgac

SEQ ID NO: 496345 - DNA, 15 bp, Homo sapiens
taacacaagatgact

SEQ ID NO: 496346 - DNA, 15 bp, Homo sapiens
aacacaagatgactt

SEQ ID NO: 496347 - DNA, 15 bp, Homo sapiens
acacaagatgacttt

SEQ ID NO: 496348 - DNA, 15 bp, Homo sapiens
cacaagatgactttg

SEQ ID NO: 496349 - DNA, 15 bp, Homo sapiens
acaagatgactttga

SEQ ID NO: 496350 - DNA, 15 bp, Homo sapiens
caagatgactttgat

SEQ ID NO: 496351 - DNA, 15 bp, Homo sapiens
aagatgactttgata

SEQ ID NO: 496352 - DNA, 15 bp, Homo sapiens
agatgactttgatat

SEQ ID NO: 496353 - DNA, 15 bp, Homo sapiens
gatgactttgatatt

SEQ ID NO: 496354 - DNA, 15 bp, Homo sapiens
atgactttgatattc

SEQ ID NO: 496355 - DNA, 15 bp, Homo sapiens
tgactttgatattct

SEQ ID NO: 496356 - DNA, 15 bp, Homo sapiens
gactttgatattctt

SEQ ID NO: 496357 - DNA, 15 bp, Homo sapiens
actttgatattcttc

SEQ ID NO: 496358 - DNA, 15 bp, Homo sapiens
ctttgatattcttca

SEQ ID NO: 496359 - DNA, 15 bp, Homo sapiens
tttgatattcttcag

SEQ ID NO: 496360 - DNA, 15 bp, Homo sapiens
ttgatattcttcagc

SEQ ID NO: 496361 - DNA, 15 bp, Homo sapiens
tgatattcttcagct

SEQ ID NO: 496362 - DNA, 15 bp, Homo sapiens
gatattcttcagctg

SEQ ID NO: 496363 - DNA, 15 bp, Homo sapiens
atattcttcagctgg

SEQ ID NO: 496364 - DNA, 15 bp, Homo sapiens
tattcttcagctgga

SEQ ID NO: 496365 - DNA, 15 bp, Homo sapiens
attcttcagctggat

SEQ ID NO: 496366 - DNA, 15 bp, Homo sapiens
ttcttcagctggatt

SEQ ID NO: 496367 - DNA, 15 bp, Homo sapiens
tcttcagctggattc

SEQ ID NO: 496368 - DNA, 15 bp, Homo sapiens
cttcagctggattca

SEQ ID NO: 496369 - DNA, 15 bp, Homo sapiens
ttcagctggattcac

SEQ ID NO: 496370 - DNA, 15 bp, Homo sapiens
tcagctggattcact

SEQ ID NO: 496371 - DNA, 15 bp, Homo sapiens
cagctggattcactg

SEQ ID NO: 496372 - DNA, 15 bp, Homo sapiens
agctggattcactga

SEQ ID NO: 496373 - DNA, 15 bp, Homo sapiens
gctggattcactgat

SEQ ID NO: 496374 - DNA, 15 bp, Homo sapiens
ctggattcactgata

SEQ ID NO: 496375 - DNA, 15 bp, Homo sapiens
tggattcactgatag

SEQ ID NO: 496376 - DNA, 15 bp, Homo sapiens
ggattcactgataga

SEQ ID NO: 496377 - DNA, 15 bp, Homo sapiens
gattcactgatagaa

SEQ ID NO: 496378 - DNA, 15 bp, Homo sapiens
attcactgatagaat

SEQ ID NO: 496379 - DNA, 15 bp, Homo sapiens
ttcactgatagaatg

SEQ ID NO: 496380 - DNA, 15 bp, Homo sapiens
tcactgatagaatgt

SEQ ID NO: 496381 - DNA, 15 bp, Homo sapiens
cactgatagaatgtg

SEQ ID NO: 496382 - DNA, 15 bp, Homo sapiens
actgatagaatgtga

SEQ ID NO: 496383 - DNA, 15 bp, Homo sapiens
ctgatagaatgtgag

SEQ ID NO: 496384 - DNA, 15 bp, Homo sapiens
tgatagaatgtgagt

SEQ ID NO: 496385 - DNA, 15 bp, Homo sapiens
gatagaatgtgagtt

SEQ ID NO: 496386 - DNA, 15 bp, Homo sapiens
atagaatgtgagttt

SEQ ID NO: 496387 - DNA, 15 bp, Homo sapiens
tagaatgtgagtttt

SEQ ID NO: 496388 - DNA, 15 bp, Homo sapiens
agaatgtgagttttg

SEQ ID NO: 496389 - DNA, 15 bp, Homo sapiens
gaatgtgagttttga

SEQ ID NO: 496390 - DNA, 15 bp, Homo sapiens
aatgtgagttttgaa

SEQ ID NO: 496391 - DNA, 15 bp, Homo sapiens
atgtgagttttgaat

SEQ ID NO: 496392 - DNA, 15 bp, Homo sapiens
tgtgagttttgaatg

SEQ ID NO: 496393 - DNA, 15 bp, Homo sapiens
gtgagttttgaatgc

SEQ ID NO: 496394 - DNA, 15 bp, Homo sapiens
tgagttttgaatgca

SEQ ID NO: 496395 - DNA, 15 bp, Homo sapiens
gagttttgaatgcac

SEQ ID NO: 496396 - DNA, 15 bp, Homo sapiens
agttttgaatgcaca

SEQ ID NO: 496397 - DNA, 15 bp, Homo sapiens
gttttgaatgcacat

SEQ ID NO: 496398 - DNA, 15 bp, Homo sapiens
ttttgaatgcacatt

SEQ ID NO: 496399 - DNA, 15 bp, Homo sapiens
tttgaatgcacattt

SEQ ID NO: 496400 - DNA, 15 bp, Homo sapiens
ttgaatgcacattta

SEQ ID NO: 496401 - DNA, 15 bp, Homo sapiens
tgaatgcacatttat

SEQ ID NO: 496402 - DNA, 15 bp, Homo sapiens
gaatgcacatttatg

SEQ ID NO: 496403 - DNA, 15 bp, Homo sapiens
aatgcacatttatga

SEQ ID NO: 496404 - DNA, 15 bp, Homo sapiens
atgcacatttatgaa

SEQ ID NO: 496405 - DNA, 15 bp, Homo sapiens
tgcacatttatgaaa

SEQ ID NO: 496406 - DNA, 15 bp, Homo sapiens
gcacatttatgaaaa

SEQ ID NO: 496407 - DNA, 15 bp, Homo sapiens
cacatttatgaaaac

SEQ ID NO: 496408 - DNA, 15 bp, Homo sapiens
acatttatgaaaaca

SEQ ID NO: 496409 - DNA, 15 bp, Homo sapiens
catttatgaaaacaa

SEQ ID NO: 496410 - DNA, 15 bp, Homo sapiens
atttatgaaaacaag

SEQ ID NO: 496411 - DNA, 15 bp, Homo sapiens
tttatgaaaacaaga

SEQ ID NO: 496412 - DNA, 15 bp, Homo sapiens
ttatgaaaacaagat

SEQ ID NO: 496413 - DNA, 15 bp, Homo sapiens
tatgaaaacaagata

SEQ ID NO: 496414 - DNA, 15 bp, Homo sapiens
atgaaaacaagatat

SEQ ID NO: 496415 - DNA, 15 bp, Homo sapiens
tgaaaacaagatata

SEQ ID NO: 496416 - DNA, 15 bp, Homo sapiens
gaaaacaagatatag

SEQ ID NO: 496417 - DNA, 15 bp, Homo sapiens
aaaacaagatataga

SEQ ID NO: 496418 - DNA, 15 bp, Homo sapiens
aaacaagatatagag

SEQ ID NO: 496419 - DNA, 15 bp, Homo sapiens
aacaagatatagaga

SEQ ID NO: 496420 - DNA, 15 bp, Homo sapiens
acaagatatagagat

SEQ ID NO: 496421 - DNA, 15 bp, Homo sapiens
caagatatagagata

SEQ ID NO: 496422 - DNA, 15 bp, Homo sapiens
aagatatagagatag

SEQ ID NO: 496423 - DNA, 15 bp, Homo sapiens
agatatagagatagc

SEQ ID NO: 496424 - DNA, 15 bp, Homo sapiens
gatatagagatagcc

SEQ ID NO: 496425 - DNA, 15 bp, Homo sapiens
atatagagatagcct

SEQ ID NO: 496426 - DNA, 15 bp, Homo sapiens
tatagagatagcctg

SEQ ID NO: 496427 - DNA, 15 bp, Homo sapiens
atagagatagcctgt

SEQ ID NO: 496428 - DNA, 15 bp, Homo sapiens
tagagatagcctgtg

SEQ ID NO: 496429 - DNA, 15 bp, Homo sapiens
agagatagcctgtgt

SEQ ID NO: 496430 - DNA, 15 bp, Homo sapiens
gagatagcctgtgtc

SEQ ID NO: 496431 - DNA, 15 bp, Homo sapiens
agatagcctgtgtcc

SEQ ID NO: 496432 - DNA, 15 bp, Homo sapiens
gatagcctgtgtcct

SEQ ID NO: 496433 - DNA, 15 bp, Homo sapiens
atagcctgtgtcctg

SEQ ID NO: 496434 - DNA, 15 bp, Homo sapiens
tagcctgtgtcctga

SEQ ID NO: 496435 - DNA, 15 bp, Homo sapiens
agcctgtgtcctgat

SEQ ID NO: 496436 - DNA, 15 bp, Homo sapiens
gcctgtgtcctgata

SEQ ID NO: 496437 - DNA, 15 bp, Homo sapiens
cctgtgtcctgatac

SEQ ID NO: 496438 - DNA, 15 bp, Homo sapiens
ctgtgtcctgataca

SEQ ID NO: 496439 - DNA, 15 bp, Homo sapiens
tgtgtcctgatacat

SEQ ID NO: 496440 - DNA, 15 bp, Homo sapiens
gtgtcctgatacatc

SEQ ID NO: 496441 - DNA, 15 bp, Homo sapiens
tgtcctgatacatct

SEQ ID NO: 496442 - DNA, 15 bp, Homo sapiens
gtcctgatacatcta

SEQ ID NO: 496443 - DNA, 15 bp, Homo sapiens
tcctgatacatctac

SEQ ID NO: 496444 - DNA, 15 bp, Homo sapiens
cctgatacatctaca

SEQ ID NO: 496445 - DNA, 15 bp, Homo sapiens
ctgatacatctacat

SEQ ID NO: 496446 - DNA, 15 bp, Homo sapiens
tgatacatctacatt

SEQ ID NO: 496447 - DNA, 15 bp, Homo sapiens
gatacatctacattt

SEQ ID NO: 496448 - DNA, 15 bp, Homo sapiens
atacatctacatttt

SEQ ID NO: 496449 - DNA, 15 bp, Homo sapiens
tacatctacattttt

SEQ ID NO: 496450 - DNA, 15 bp, Homo sapiens
acatctacatttttt

SEQ ID NO: 496451 - DNA, 15 bp, Homo sapiens
catctacattttttc

SEQ ID NO: 496452 - DNA, 15 bp, Homo sapiens
atctacattttttcc

SEQ ID NO: 496453 - DNA, 15 bp, Homo sapiens
tctacattttttcct

SEQ ID NO: 496454 - DNA, 15 bp, Homo sapiens
ctacattttttcctg

SEQ ID NO: 496455 - DNA, 15 bp, Homo sapiens
tacattttttcctgc

SEQ ID NO: 496456 - DNA, 15 bp, Homo sapiens
acattttttcctgca

SEQ ID NO: 496457 - DNA, 15 bp, Homo sapiens
cattttttcctgcag

SEQ ID NO: 496458 - DNA, 15 bp, Homo sapiens
attttttcctgcagt

SEQ ID NO: 496459 - DNA, 15 bp, Homo sapiens
ttttttcctgcagtt

SEQ ID NO: 496460 - DNA, 15 bp, Homo sapiens
tttttcctgcagttt

SEQ ID NO: 496461 - DNA, 15 bp, Homo sapiens
ttttcctgcagtttc

SEQ ID NO: 496462 - DNA, 15 bp, Homo sapiens
tttcctgcagtttct

SEQ ID NO: 496463 - DNA, 15 bp, Homo sapiens
ttcctgcagtttctc

SEQ ID NO: 496464 - DNA, 15 bp, Homo sapiens
tcctgcagtttctct

SEQ ID NO: 496465 - DNA, 15 bp, Homo sapiens
cctgcagtttctctc

SEQ ID NO: 496466 - DNA, 15 bp, Homo sapiens
ctgcagtttctctca

SEQ ID NO: 496467 - DNA, 15 bp, Homo sapiens
tgcagtttctctcat

SEQ ID NO: 496468 - DNA, 15 bp, Homo sapiens
gcagtttctctcata

SEQ ID NO: 496469 - DNA, 15 bp, Homo sapiens
cagtttctctcatac

SEQ ID NO: 496470 - DNA, 15 bp, Homo sapiens
agtttctctcataca

SEQ ID NO: 496471 - DNA, 15 bp, Homo sapiens
gtttctctcatacac

SEQ ID NO: 496472 - DNA, 15 bp, Homo sapiens
tttctctcatacaca

SEQ ID NO: 496473 - DNA, 15 bp, Homo sapiens
ttctctcatacacac

SEQ ID NO: 496474 - DNA, 15 bp, Homo sapiens
tctctcatacacact

SEQ ID NO: 496475 - DNA, 15 bp, Homo sapiens
ctctcatacacacta

SEQ ID NO: 496476 - DNA, 15 bp, Homo sapiens
tctcatacacactaa

SEQ ID NO: 496477 - DNA, 15 bp, Homo sapiens
ctcatacacactaat

SEQ ID NO: 496478 - DNA, 15 bp, Homo sapiens
tcatacacactaata

SEQ ID NO: 496479 - DNA, 15 bp, Homo sapiens
catacacactaatac

SEQ ID NO: 496480 - DNA, 15 bp, Homo sapiens
atacacactaataca

SEQ ID NO: 496481 - DNA, 15 bp, Homo sapiens
tacacactaatacag

SEQ ID NO: 496482 - DNA, 15 bp, Homo sapiens
acacactaatacagt

SEQ ID NO: 496483 - DNA, 15 bp, Homo sapiens
cacactaatacagtc

SEQ ID NO: 496484 - DNA, 15 bp, Homo sapiens
acactaatacagtct

SEQ ID NO: 496485 - DNA, 15 bp, Homo sapiens
cactaatacagtctc

SEQ ID NO: 496486 - DNA, 15 bp, Homo sapiens
actaatacagtctcc

SEQ ID NO: 496487 - DNA, 15 bp, Homo sapiens
ctaatacagtctcct

SEQ ID NO: 496488 - DNA, 15 bp, Homo sapiens
taatacagtctcctg

SEQ ID NO: 496489 - DNA, 15 bp, Homo sapiens
aatacagtctcctgt

SEQ ID NO: 496490 - DNA, 15 bp, Homo sapiens
atacagtctcctgtt

SEQ ID NO: 496491 - DNA, 15 bp, Homo sapiens
tacagtctcctgttg

SEQ ID NO: 496492 - DNA, 15 bp, Homo sapiens
acagtctcctgttgc

SEQ ID NO: 496493 - DNA, 15 bp, Homo sapiens
cagtctcctgttgct

SEQ ID NO: 496494 - DNA, 15 bp, Homo sapiens
agtctcctgttgctc

SEQ ID NO: 496495 - DNA, 15 bp, Homo sapiens
gtctcctgttgctct

SEQ ID NO: 496496 - DNA, 15 bp, Homo sapiens
tctcctgttgctctc

SEQ ID NO: 496497 - DNA, 15 bp, Homo sapiens
ctcctgttgctctca

SEQ ID NO: 496498 - DNA, 15 bp, Homo sapiens
tcctgttgctctcat

SEQ ID NO: 496499 - DNA, 15 bp, Homo sapiens
cctgttgctctcatt

SEQ ID NO: 496500 - DNA, 15 bp, Homo sapiens
ctgttgctctcattc

SEQ ID NO: 496501 - DNA, 15 bp, Homo sapiens
tgttgctctcattct

SEQ ID NO: 496502 - DNA, 15 bp, Homo sapiens
gttgctctcattctc

SEQ ID NO: 496503 - DNA, 15 bp, Homo sapiens
ttgctctcattctct

SEQ ID NO: 496504 - DNA, 15 bp, Homo sapiens
tgctctcattctctc

SEQ ID NO: 496505 - DNA, 15 bp, Homo sapiens
gctctcattctctct

SEQ ID NO: 496506 - DNA, 15 bp, Homo sapiens
cattctctctctctc

SEQ ID NO: 496507 - DNA, 15 bp, Homo sapiens
attctctctctctcc

SEQ ID NO: 496508 - DNA, 15 bp, Homo sapiens
ttctctctctctccc

SEQ ID NO: 496509 - DNA, 15 bp, Homo sapiens
tctctctctctcccc

SEQ ID NO: 496510 - DNA, 15 bp, Homo sapiens
ctctctctctcccca

SEQ ID NO: 496511 - DNA, 15 bp, Homo sapiens
tctctctctccccat

SEQ ID NO: 496512 - DNA, 15 bp, Homo sapiens
ctctctctccccatc

SEQ ID NO: 496513 - DNA, 15 bp, Homo sapiens
tctctctccccatct

SEQ ID NO: 496514 - DNA, 15 bp, Homo sapiens
ctctctccccatctc

SEQ ID NO: 496515 - DNA, 15 bp, Homo sapiens
tctctccccatctct

SEQ ID NO: 496516 - DNA, 15 bp, Homo sapiens
ctctccccatctctt

SEQ ID NO: 496517 - DNA, 15 bp, Homo sapiens
tctccccatctctta

SEQ ID NO: 496518 - DNA, 15 bp, Homo sapiens
ctccccatctcttac

SEQ ID NO: 496519 - DNA, 15 bp, Homo sapiens
tccccatctcttaca

SEQ ID NO: 496520 - DNA, 15 bp, Homo sapiens
ccccatctcttacac

SEQ ID NO: 496521 - DNA, 15 bp, Homo sapiens
cccatctcttacaca

SEQ ID NO: 496522 - DNA, 15 bp, Homo sapiens
ccatctcttacacat

SEQ ID NO: 496523 - DNA, 15 bp, Homo sapiens
catctcttacacata

SEQ ID NO: 496524 - DNA, 15 bp, Homo sapiens
atctcttacacatac

SEQ ID NO: 496525 - DNA, 15 bp, Homo sapiens
tctcttacacataca

SEQ ID NO: 496526 - DNA, 15 bp, Homo sapiens
ctcttacacatacat

SEQ ID NO: 496527 - DNA, 15 bp, Homo sapiens
tcttacacatacata

SEQ ID NO: 496528 - DNA, 15 bp, Homo sapiens
cttacacatacatat

SEQ ID NO: 496529 - DNA, 15 bp, Homo sapiens
ttacacatacatata

SEQ ID NO: 496530 - DNA, 15 bp, Homo sapiens
tacacatacatataa

SEQ ID NO: 496531 - DNA, 15 bp, Homo sapiens
acacatacatataat

SEQ ID NO: 496532 - DNA, 15 bp, Homo sapiens
cacatacatataatt

SEQ ID NO: 496533 - DNA, 15 bp, Homo sapiens
acatacatataatta

SEQ ID NO: 496534 - DNA, 15 bp, Homo sapiens
catacatataattat

SEQ ID NO: 496535 - DNA, 15 bp, Homo sapiens
atacatataattata

SEQ ID NO: 496536 - DNA, 15 bp, Homo sapiens
tacatataattatat

SEQ ID NO: 496537 - DNA, 15 bp, Homo sapiens
acatataattatatg

SEQ ID NO: 496538 - DNA, 15 bp, Homo sapiens
catataattatatga

SEQ ID NO: 496539 - DNA, 15 bp, Homo sapiens
atataattatatgat

SEQ ID NO: 496540 - DNA, 15 bp, Homo sapiens
tataattatatgatt

SEQ ID NO: 496541 - DNA, 15 bp, Homo sapiens
ataattatatgattc

SEQ ID NO: 496542 - DNA, 15 bp, Homo sapiens
taattatatgattct

SEQ ID NO: 496543 - DNA, 15 bp, Homo sapiens
aattatatgattctc

SEQ ID NO: 496544 - DNA, 15 bp, Homo sapiens
attatatgattctca

SEQ ID NO: 496545 - DNA, 15 bp, Homo sapiens
ttatatgattctcaa

SEQ ID NO: 496546 - DNA, 15 bp, Homo sapiens
tatatgattctcaat

SEQ ID NO: 496547 - DNA, 15 bp, Homo sapiens
atatgattctcaatt

SEQ ID NO: 496548 - DNA, 15 bp, Homo sapiens
tatgattctcaattt

SEQ ID NO: 496549 - DNA, 15 bp, Homo sapiens
atgattctcaattta

SEQ ID NO: 496550 - DNA, 15 bp, Homo sapiens
tgattctcaatttat

SEQ ID NO: 496551 - DNA, 15 bp, Homo sapiens
gattctcaatttatt

SEQ ID NO: 496552 - DNA, 15 bp, Homo sapiens
attctcaatttattt

SEQ ID NO: 496553 - DNA, 15 bp, Homo sapiens
ttctcaatttatttt

SEQ ID NO: 496554 - DNA, 15 bp, Homo sapiens
tctcaatttattttc

SEQ ID NO: 496555 - DNA, 15 bp, Homo sapiens
ctcaatttattttcc

SEQ ID NO: 496556 - DNA, 15 bp, Homo sapiens
tcaatttattttcca

SEQ ID NO: 496557 - DNA, 15 bp, Homo sapiens
caatttattttccag

SEQ ID NO: 496558 - DNA, 15 bp, Homo sapiens
aatttattttccaga

SEQ ID NO: 496559 - DNA, 15 bp, Homo sapiens
atttattttccagat

SEQ ID NO: 496560 - DNA, 15 bp, Homo sapiens
tttattttccagata

SEQ ID NO: 496561 - DNA, 15 bp, Homo sapiens
ttattttccagatag

SEQ ID NO: 496562 - DNA, 15 bp, Homo sapiens
tattttccagataga

SEQ ID NO: 496563 - DNA, 15 bp, Homo sapiens
attttccagatagaa

SEQ ID NO: 496564 - DNA, 15 bp, Homo sapiens
ttttccagatagaag

SEQ ID NO: 496565 - DNA, 15 bp, Homo sapiens
tttccagatagaagg

SEQ ID NO: 496566 - DNA, 15 bp, Homo sapiens
ttccagatagaaggt

SEQ ID NO: 496567 - DNA, 15 bp, Homo sapiens
tccagatagaaggtt

SEQ ID NO: 496568 - DNA, 15 bp, Homo sapiens
ccagatagaaggttt

SEQ ID NO: 496569 - DNA, 15 bp, Homo sapiens
cagatagaaggttta

SEQ ID NO: 496570 - DNA, 15 bp, Homo sapiens
agatagaaggtttat

SEQ ID NO: 496571 - DNA, 15 bp, Homo sapiens
gatagaaggtttatt

SEQ ID NO: 496572 - DNA, 15 bp, Homo sapiens
atagaaggtttattg

SEQ ID NO: 496573 - DNA, 15 bp, Homo sapiens
tagaaggtttattga

SEQ ID NO: 496574 - DNA, 15 bp, Homo sapiens
agaaggtttattgat

SEQ ID NO: 496575 - DNA, 15 bp, Homo sapiens
gaaggtttattgata

SEQ ID NO: 496576 - DNA, 15 bp, Homo sapiens
aaggtttattgatag

SEQ ID NO: 496577 - DNA, 15 bp, Homo sapiens
aggtttattgataga

SEQ ID NO: 496578 - DNA, 15 bp, Homo sapiens
ggtttattgatagag

SEQ ID NO: 496579 - DNA, 15 bp, Homo sapiens
gtttattgatagaga

SEQ ID NO: 496580 - DNA, 15 bp, Homo sapiens
tttattgatagagaa

SEQ ID NO: 496581 - DNA, 15 bp, Homo sapiens
ttattgatagagaaa

SEQ ID NO: 496582 - DNA, 15 bp, Homo sapiens
tattgatagagaaaa

SEQ ID NO: 496583 - DNA, 15 bp, Homo sapiens
attgatagagaaaag

SEQ ID NO: 496584 - DNA, 15 bp, Homo sapiens
ttgatagagaaaagt

SEQ ID NO: 496585 - DNA, 15 bp, Homo sapiens
tgatagagaaaagta

SEQ ID NO: 496586 - DNA, 15 bp, Homo sapiens
gatagagaaaagtaa

SEQ ID NO: 496587 - DNA, 15 bp, Homo sapiens
atagagaaaagtaat

SEQ ID NO: 496588 - DNA, 15 bp, Homo sapiens
tagagaaaagtaata

SEQ ID NO: 496589 - DNA, 15 bp, Homo sapiens
agagaaaagtaatat

SEQ ID NO: 496590 - DNA, 15 bp, Homo sapiens
gagaaaagtaatatt

SEQ ID NO: 496591 - DNA, 15 bp, Homo sapiens
agaaaagtaatattg

SEQ ID NO: 496592 - DNA, 15 bp, Homo sapiens
gaaaagtaatattgg

SEQ ID NO: 496593 - DNA, 15 bp, Homo sapiens
aaaagtaatattgga

SEQ ID NO: 496594 - DNA, 15 bp, Homo sapiens
aaagtaatattggat

SEQ ID NO: 496595 - DNA, 15 bp, Homo sapiens
aagtaatattggatg

SEQ ID NO: 496596 - DNA, 15 bp, Homo sapiens
agtaatattggatgt

SEQ ID NO: 496597 - DNA, 15 bp, Homo sapiens
gtaatattggatgta

SEQ ID NO: 496598 - DNA, 15 bp, Homo sapiens
taatattggatgtaa

SEQ ID NO: 496599 - DNA, 15 bp, Homo sapiens
aatattggatgtaaa

SEQ ID NO: 496600 - DNA, 15 bp, Homo sapiens
atattggatgtaaaa

SEQ ID NO: 496601 - DNA, 15 bp, Homo sapiens
tattggatgtaaaaa

SEQ ID NO: 496602 - DNA, 15 bp, Homo sapiens
attggatgtaaaaat

SEQ ID NO: 496603 - DNA, 15 bp, Homo sapiens
ttggatgtaaaaatg

SEQ ID NO: 496604 - DNA, 15 bp, Homo sapiens
tggatgtaaaaatgt

SEQ ID NO: 496605 - DNA, 15 bp, Homo sapiens
ggatgtaaaaatgtg

SEQ ID NO: 496606 - DNA, 15 bp, Homo sapiens
gatgtaaaaatgtgt

SEQ ID NO: 496607 - DNA, 15 bp, Homo sapiens
atgtaaaaatgtgta

SEQ ID NO: 496608 - DNA, 15 bp, Homo sapiens
tgtaaaaatgtgtac

SEQ ID NO: 496609 - DNA, 15 bp, Homo sapiens
gtaaaaatgtgtaca

SEQ ID NO: 496610 - DNA, 15 bp, Homo sapiens
taaaaatgtgtacat

SEQ ID NO: 496611 - DNA, 15 bp, Homo sapiens
aaaaatgtgtacata

SEQ ID NO: 496612 - DNA, 15 bp, Homo sapiens
aaaatgtgtacataa

SEQ ID NO: 496613 - DNA, 15 bp, Homo sapiens
aaatgtgtacataaa

SEQ ID NO: 496614 - DNA, 15 bp, Homo sapiens
aatgtgtacataaaa

SEQ ID NO: 496615 - DNA, 15 bp, Homo sapiens
atgtgtacataaaac

SEQ ID NO: 496616 - DNA, 15 bp, Homo sapiens
tgtgtacataaaacc

SEQ ID NO: 496617 - DNA, 15 bp, Homo sapiens
gtgtacataaaacct

SEQ ID NO: 496618 - DNA, 15 bp, Homo sapiens
tgtacataaaacctg

SEQ ID NO: 496619 - DNA, 15 bp, Homo sapiens
gtacataaaacctgt

SEQ ID NO: 496620 - DNA, 15 bp, Homo sapiens
tacataaaacctgtt

SEQ ID NO: 496621 - DNA, 15 bp, Homo sapiens
acataaaacctgttg

SEQ ID NO: 496622 - DNA, 15 bp, Homo sapiens
cataaaacctgttga

SEQ ID NO: 496623 - DNA, 15 bp, Homo sapiens
ataaaacctgttgag

SEQ ID NO: 496624 - DNA, 15 bp, Homo sapiens
taaaacctgttgagt

SEQ ID NO: 496625 - DNA, 15 bp, Homo sapiens
aaaacctgttgagtg

SEQ ID NO: 496626 - DNA, 15 bp, Homo sapiens
aaacctgttgagtgt

SEQ ID NO: 496627 - DNA, 15 bp, Homo sapiens
aacctgttgagtgtt

SEQ ID NO: 496628 - DNA, 15 bp, Homo sapiens
acctgttgagtgttt

SEQ ID NO: 496629 - DNA, 15 bp, Homo sapiens
cctgttgagtgtttt

SEQ ID NO: 496630 - DNA, 15 bp, Homo sapiens
ctgttgagtgtttta

SEQ ID NO: 496631 - DNA, 15 bp, Homo sapiens
tgttgagtgttttaa

SEQ ID NO: 496632 - DNA, 15 bp, Homo sapiens
gttgagtgttttaat

SEQ ID NO: 496633 - DNA, 15 bp, Homo sapiens
ttgagtgttttaata

SEQ ID NO: 496634 - DNA, 15 bp, Homo sapiens
tgagtgttttaataa

SEQ ID NO: 496635 - DNA, 15 bp, Homo sapiens
gagtgttttaataac

SEQ ID NO: 496636 - DNA, 15 bp, Homo sapiens
agtgttttaataact

SEQ ID NO: 496637 - DNA, 15 bp, Homo sapiens
gtgttttaataacta

SEQ ID NO: 496638 - DNA, 15 bp, Homo sapiens
tgttttaataactag

SEQ ID NO: 496639 - DNA, 15 bp, Homo sapiens
gttttaataactaga

SEQ ID NO: 496640 - DNA, 15 bp, Homo sapiens
ttttaataactagat

SEQ ID NO: 496641 - DNA, 15 bp, Homo sapiens
tttaataactagatg

SEQ ID NO: 496642 - DNA, 15 bp, Homo sapiens
ttaataactagatgc

SEQ ID NO: 496643 - DNA, 15 bp, Homo sapiens
taataactagatgct

SEQ ID NO: 496644 - DNA, 15 bp, Homo sapiens
aataactagatgctg

SEQ ID NO: 496645 - DNA, 15 bp, Homo sapiens
ataactagatgctgt

SEQ ID NO: 496646 - DNA, 15 bp, Homo sapiens
taactagatgctgtt

SEQ ID NO: 496647 - DNA, 15 bp, Homo sapiens
aactagatgctgttg

SEQ ID NO: 496648 - DNA, 15 bp, Homo sapiens
actagatgctgttga

SEQ ID NO: 496649 - DNA, 15 bp, Homo sapiens
ctagatgctgttgac

SEQ ID NO: 496650 - DNA, 15 bp, Homo sapiens
tagatgctgttgaca

SEQ ID NO: 496651 - DNA, 15 bp, Homo sapiens
agatgctgttgacat

SEQ ID NO: 496652 - DNA, 15 bp, Homo sapiens
gatgctgttgacatt

SEQ ID NO: 496653 - DNA, 15 bp, Homo sapiens
atgctgttgacatta

SEQ ID NO: 496654 - DNA, 15 bp, Homo sapiens
tgctgttgacattaa

SEQ ID NO: 496655 - DNA, 15 bp, Homo sapiens
gctgttgacattaag

SEQ ID NO: 496656 - DNA, 15 bp, Homo sapiens
ctgttgacattaagt

SEQ ID NO: 496657 - DNA, 15 bp, Homo sapiens
tgttgacattaagtt

SEQ ID NO: 496658 - DNA, 15 bp, Homo sapiens
gttgacattaagttc

SEQ ID NO: 496659 - DNA, 15 bp, Homo sapiens
ttgacattaagttcc

SEQ ID NO: 496660 - DNA, 15 bp, Homo sapiens
tgacattaagttcct

SEQ ID NO: 496661 - DNA, 15 bp, Homo sapiens
gacattaagttcctt

SEQ ID NO: 496662 - DNA, 15 bp, Homo sapiens
acattaagttccttt

SEQ ID NO: 496663 - DNA, 15 bp, Homo sapiens
cattaagttcctttc

SEQ ID NO: 496664 - DNA, 15 bp, Homo sapiens
attaagttcctttca

SEQ ID NO: 496665 - DNA, 15 bp, Homo sapiens
ttaagttcctttcaa

SEQ ID NO: 496666 - DNA, 15 bp, Homo sapiens
taagttcctttcaaa

SEQ ID NO: 496667 - DNA, 15 bp, Homo sapiens
aagttcctttcaaat

SEQ ID NO: 496668 - DNA, 15 bp, Homo sapiens
agttcctttcaaatg

SEQ ID NO: 496669 - DNA, 15 bp, Homo sapiens
gttcctttcaaatgt

SEQ ID NO: 496670 - DNA, 15 bp, Homo sapiens
ttcctttcaaatgta

SEQ ID NO: 496671 - DNA, 15 bp, Homo sapiens
tcctttcaaatgtac

SEQ ID NO: 496672 - DNA, 15 bp, Homo sapiens
cctttcaaatgtact

SEQ ID NO: 496673 - DNA, 15 bp, Homo sapiens
ctttcaaatgtactt

SEQ ID NO: 496674 - DNA, 15 bp, Homo sapiens
tttcaaatgtacttt

SEQ ID NO: 496675 - DNA, 15 bp, Homo sapiens
ttcaaatgtactttt

SEQ ID NO: 496676 - DNA, 15 bp, Homo sapiens
tcaaatgtactttta

SEQ ID NO: 496677 - DNA, 15 bp, Homo sapiens
caaatgtacttttag

SEQ ID NO: 496678 - DNA, 15 bp, Homo sapiens
aaatgtacttttagt

SEQ ID NO: 496679 - DNA, 15 bp, Homo sapiens
aatgtacttttagtt

SEQ ID NO: 496680 - DNA, 15 bp, Homo sapiens
atgtacttttagttt

SEQ ID NO: 496681 - DNA, 15 bp, Homo sapiens
tgtacttttagtttc

SEQ ID NO: 496682 - DNA, 15 bp, Homo sapiens
gtacttttagtttca

SEQ ID NO: 496683 - DNA, 15 bp, Homo sapiens
tacttttagtttcat

SEQ ID NO: 496684 - DNA, 15 bp, Homo sapiens
acttttagtttcatg

SEQ ID NO: 496685 - DNA, 15 bp, Homo sapiens
cttttagtttcatgc

SEQ ID NO: 496686 - DNA, 15 bp, Homo sapiens
ttttagtttcatgct

SEQ ID NO: 496687 - DNA, 15 bp, Homo sapiens
tttagtttcatgctc

SEQ ID NO: 496688 - DNA, 15 bp, Homo sapiens
ttagtttcatgctct

SEQ ID NO: 496689 - DNA, 15 bp, Homo sapiens
tagtttcatgctctc

SEQ ID NO: 496690 - DNA, 15 bp, Homo sapiens
agtttcatgctctca

SEQ ID NO: 496691 - DNA, 15 bp, Homo sapiens
gtttcatgctctcaa

SEQ ID NO: 496692 - DNA, 15 bp, Homo sapiens
tttcatgctctcaaa

SEQ ID NO: 496693 - DNA, 15 bp, Homo sapiens
ttcatgctctcaaat

SEQ ID NO: 496694 - DNA, 15 bp, Homo sapiens
tcatgctctcaaata

SEQ ID NO: 496695 - DNA, 15 bp, Homo sapiens
catgctctcaaatac

SEQ ID NO: 496696 - DNA, 15 bp, Homo sapiens
atgctctcaaatact

SEQ ID NO: 496697 - DNA, 15 bp, Homo sapiens
tgctctcaaatactg

SEQ ID NO: 496698 - DNA, 15 bp, Homo sapiens
gctctcaaatactgt

SEQ ID NO: 496699 - DNA, 15 bp, Homo sapiens
ctctcaaatactgta

SEQ ID NO: 496700 - DNA, 15 bp, Homo sapiens
tctcaaatactgtat

SEQ ID NO: 496701 - DNA, 15 bp, Homo sapiens
ctcaaatactgtatg

SEQ ID NO: 496702 - DNA, 15 bp, Homo sapiens
tcaaatactgtatgc

SEQ ID NO: 496703 - DNA, 15 bp, Homo sapiens
caaatactgtatgct

SEQ ID NO: 496704 - DNA, 15 bp, Homo sapiens
aaatactgtatgctt

SEQ ID NO: 496705 - DNA, 15 bp, Homo sapiens
aatactgtatgcttt

SEQ ID NO: 496706 - DNA, 15 bp, Homo sapiens
atactgtatgctttt

SEQ ID NO: 496707 - DNA, 15 bp, Homo sapiens
tactgtatgcttttt

SEQ ID NO: 496708 - DNA, 15 bp, Homo sapiens
actgtatgcttttta

SEQ ID NO: 496709 - DNA, 15 bp, Homo sapiens
ctgtatgctttttat

SEQ ID NO: 496710 - DNA, 15 bp, Homo sapiens
tgtatgctttttatc

SEQ ID NO: 496711 - DNA, 15 bp, Homo sapiens
gtatgctttttatcc

SEQ ID NO: 496712 - DNA, 15 bp, Homo sapiens
tatgctttttatccg

SEQ ID NO: 496713 - DNA, 15 bp, Homo sapiens
atgctttttatccgt

SEQ ID NO: 496714 - DNA, 15 bp, Homo sapiens
tgctttttatccgta

SEQ ID NO: 496715 - DNA, 15 bp, Homo sapiens
gctttttatccgtac

SEQ ID NO: 496716 - DNA, 15 bp, Homo sapiens
ctttttatccgtaca

SEQ ID NO: 496717 - DNA, 15 bp, Homo sapiens
tttttatccgtacac

SEQ ID NO: 496718 - DNA, 15 bp, Homo sapiens
ttttatccgtacact

SEQ ID NO: 496719 - DNA, 15 bp, Homo sapiens
tttatccgtacactg

SEQ ID NO: 496720 - DNA, 15 bp, Homo sapiens
ttatccgtacactgg

SEQ ID NO: 496721 - DNA, 15 bp, Homo sapiens
tatccgtacactgga

SEQ ID NO: 496722 - DNA, 15 bp, Homo sapiens
atccgtacactggat

SEQ ID NO: 496723 - DNA, 15 bp, Homo sapiens
tccgtacactggatt

SEQ ID NO: 496724 - DNA, 15 bp, Homo sapiens
ccgtacactggattt

SEQ ID NO: 496725 - DNA, 15 bp, Homo sapiens
cgtacactggatttt

SEQ ID NO: 496726 - DNA, 15 bp, Homo sapiens
gtacactggatttta

SEQ ID NO: 496727 - DNA, 15 bp, Homo sapiens
tacactggattttaa

SEQ ID NO: 496728 - DNA, 15 bp, Homo sapiens
acactggattttaac

SEQ ID NO: 496729 - DNA, 15 bp, Homo sapiens
cactggattttaacc

SEQ ID NO: 496730 - DNA, 15 bp, Homo sapiens
actggattttaacca

SEQ ID NO: 496731 - DNA, 15 bp, Homo sapiens
ctggattttaaccac

SEQ ID NO: 496732 - DNA, 15 bp, Homo sapiens
tggattttaaccact

SEQ ID NO: 496733 - DNA, 15 bp, Homo sapiens
ggattttaaccactc

SEQ ID NO: 496734 - DNA, 15 bp, Homo sapiens
gattttaaccactct

SEQ ID NO: 496735 - DNA, 15 bp, Homo sapiens
attttaaccactcta

SEQ ID NO: 496736 - DNA, 15 bp, Homo sapiens
ttttaaccactctag

SEQ ID NO: 496737 - DNA, 15 bp, Homo sapiens
tttaaccactctagt

SEQ ID NO: 496738 - DNA, 15 bp, Homo sapiens
ttaaccactctagta

SEQ ID NO: 496739 - DNA, 15 bp, Homo sapiens
taaccactctagtag

SEQ ID NO: 496740 - DNA, 15 bp, Homo sapiens
aaccactctagtagg

SEQ ID NO: 496741 - DNA, 15 bp, Homo sapiens
accactctagtaggt

SEQ ID NO: 496742 - DNA, 15 bp, Homo sapiens
ccactctagtaggtt

SEQ ID NO: 496743 - DNA, 15 bp, Homo sapiens
cactctagtaggttt

SEQ ID NO: 496744 - DNA, 15 bp, Homo sapiens
actctagtaggttta

SEQ ID NO: 496745 - DNA, 15 bp, Homo sapiens
ctctagtaggtttaa

SEQ ID NO: 496746 - DNA, 15 bp, Homo sapiens
tctagtaggtttaat

SEQ ID NO: 496747 - DNA, 15 bp, Homo sapiens
ctagtaggtttaatc

SEQ ID NO: 496748 - DNA, 15 bp, Homo sapiens
tagtaggtttaatca

SEQ ID NO: 496749 - DNA, 15 bp, Homo sapiens
agtaggtttaatcaa

SEQ ID NO: 496750 - DNA, 15 bp, Homo sapiens
gtaggtttaatcaat

SEQ ID NO: 496751 - DNA, 15 bp, Homo sapiens
taggtttaatcaatt

SEQ ID NO: 496752 - DNA, 15 bp, Homo sapiens
aggtttaatcaattt

SEQ ID NO: 496753 - DNA, 15 bp, Homo sapiens
ggtttaatcaatttc

SEQ ID NO: 496754 - DNA, 15 bp, Homo sapiens
gtttaatcaatttct

SEQ ID NO: 496755 - DNA, 15 bp, Homo sapiens
tttaatcaatttctg

SEQ ID NO: 496756 - DNA, 15 bp, Homo sapiens
ttaatcaatttctga

SEQ ID NO: 496757 - DNA, 15 bp, Homo sapiens
taatcaatttctgaa

SEQ ID NO: 496758 - DNA, 15 bp, Homo sapiens
aatcaatttctgaag

SEQ ID NO: 496759 - DNA, 15 bp, Homo sapiens
atcaatttctgaagc

SEQ ID NO: 496760 - DNA, 15 bp, Homo sapiens
tcaatttctgaagcc

SEQ ID NO: 496761 - DNA, 15 bp, Homo sapiens
caatttctgaagcca

SEQ ID NO: 496762 - DNA, 15 bp, Homo sapiens
aatttctgaagccat

SEQ ID NO: 496763 - DNA, 15 bp, Homo sapiens
atttctgaagccatt

SEQ ID NO: 496764 - DNA, 15 bp, Homo sapiens
tttctgaagccattc

SEQ ID NO: 496765 - DNA, 15 bp, Homo sapiens
ttctgaagccattca

SEQ ID NO: 496766 - DNA, 15 bp, Homo sapiens
tctgaagccattcag

SEQ ID NO: 496767 - DNA, 15 bp, Homo sapiens
ctgaagccattcagt

SEQ ID NO: 496768 - DNA, 15 bp, Homo sapiens
tgaagccattcagtg

SEQ ID NO: 496769 - DNA, 15 bp, Homo sapiens
gaagccattcagtgg

SEQ ID NO: 496770 - DNA, 15 bp, Homo sapiens
aagccattcagtggg

SEQ ID NO: 496771 - DNA, 15 bp, Homo sapiens
agccattcagtggga

SEQ ID NO: 496772 - DNA, 15 bp, Homo sapiens
gccattcagtgggaa

SEQ ID NO: 496773 - DNA, 15 bp, Homo sapiens
ccattcagtgggaaa

SEQ ID NO: 496774 - DNA, 15 bp, Homo sapiens
cattcagtgggaaac

SEQ ID NO: 496775 - DNA, 15 bp, Homo sapiens
attcagtgggaaaca

SEQ ID NO: 496776 - DNA, 15 bp, Homo sapiens
ttcagtgggaaacaa

SEQ ID NO: 496777 - DNA, 15 bp, Homo sapiens
tcagtgggaaacaat

SEQ ID NO: 496778 - DNA, 15 bp, Homo sapiens
cagtgggaaacaatg

SEQ ID NO: 496779 - DNA, 15 bp, Homo sapiens
agtgggaaacaatgt

SEQ ID NO: 496780 - DNA, 15 bp, Homo sapiens
gtgggaaacaatgtt

SEQ ID NO: 496781 - DNA, 15 bp, Homo sapiens
tgggaaacaatgttg

SEQ ID NO: 496782 - DNA, 15 bp, Homo sapiens
gggaaacaatgttga

SEQ ID NO: 496783 - DNA, 15 bp, Homo sapiens
ggaaacaatgttgag

SEQ ID NO: 496784 - DNA, 15 bp, Homo sapiens
gaaacaatgttgaga

SEQ ID NO: 496785 - DNA, 15 bp, Homo sapiens
aaacaatgttgagaa

SEQ ID NO: 496786 - DNA, 15 bp, Homo sapiens
aacaatgttgagaat

SEQ ID NO: 496787 - DNA, 15 bp, Homo sapiens
acaatgttgagaatc

SEQ ID NO: 496788 - DNA, 15 bp, Homo sapiens
caatgttgagaatca

SEQ ID NO: 496789 - DNA, 15 bp, Homo sapiens
aatgttgagaatcat

SEQ ID NO: 496790 - DNA, 15 bp, Homo sapiens
atgttgagaatcatg

SEQ ID NO: 496791 - DNA, 15 bp, Homo sapiens
tgttgagaatcatgt

SEQ ID NO: 496792 - DNA, 15 bp, Homo sapiens
gttgagaatcatgtt

SEQ ID NO: 496793 - DNA, 15 bp, Homo sapiens
ttgagaatcatgttg

SEQ ID NO: 496794 - DNA, 15 bp, Homo sapiens
tgagaatcatgttgc

SEQ ID NO: 496795 - DNA, 15 bp, Homo sapiens
gagaatcatgttgct

SEQ ID NO: 496796 - DNA, 15 bp, Homo sapiens
agaatcatgttgctt

SEQ ID NO: 496797 - DNA, 15 bp, Homo sapiens
gaatcatgttgcttt

SEQ ID NO: 496798 - DNA, 15 bp, Homo sapiens
aatcatgttgcttta

SEQ ID NO: 496799 - DNA, 15 bp, Homo sapiens
atcatgttgctttat

SEQ ID NO: 496800 - DNA, 15 bp, Homo sapiens
tcatgttgctttatt

SEQ ID NO: 496801 - DNA, 15 bp, Homo sapiens
catgttgctttattc

SEQ ID NO: 496802 - DNA, 15 bp, Homo sapiens
atgttgctttattct

SEQ ID NO: 496803 - DNA, 15 bp, Homo sapiens
tgttgctttattcta

SEQ ID NO: 496804 - DNA, 15 bp, Homo sapiens
gttgctttattctaa

SEQ ID NO: 496805 - DNA, 15 bp, Homo sapiens
ttgctttattctaaa

SEQ ID NO: 496806 - DNA, 15 bp, Homo sapiens
tgctttattctaaaa

SEQ ID NO: 496807 - DNA, 15 bp, Homo sapiens
gctttattctaaaat

SEQ ID NO: 496808 - DNA, 15 bp, Homo sapiens
ctttattctaaaatt

SEQ ID NO: 496809 - DNA, 15 bp, Homo sapiens
tttattctaaaatta

SEQ ID NO: 496810 - DNA, 15 bp, Homo sapiens
ttattctaaaattaa

SEQ ID NO: 496811 - DNA, 15 bp, Homo sapiens
tattctaaaattaaa

SEQ ID NO: 496812 - DNA, 15 bp, Homo sapiens
attctaaaattaaaa

SEQ ID NO: 496813 - DNA, 15 bp, Homo sapiens
ttctaaaattaaaag

SEQ ID NO: 496814 - DNA, 15 bp, Homo sapiens
tctaaaattaaaagc

SEQ ID NO: 496815 - DNA, 15 bp, Homo sapiens
ctaaaattaaaagct

SEQ ID NO: 496816 - DNA, 15 bp, Homo sapiens
taaaattaaaagctg

SEQ ID NO: 496817 - DNA, 15 bp, Homo sapiens
aaaattaaaagctgt

SEQ ID NO: 496818 - DNA, 15 bp, Homo sapiens
aaattaaaagctgtc

SEQ ID NO: 496819 - DNA, 15 bp, Homo sapiens
aattaaaagctgtct

SEQ ID NO: 496820 - DNA, 15 bp, Homo sapiens
attaaaagctgtcta

SEQ ID NO: 496821 - DNA, 15 bp, Homo sapiens
ttaaaagctgtctat

SEQ ID NO: 496822 - DNA, 15 bp, Homo sapiens
taaaagctgtctatg

SEQ ID NO: 496823 - DNA, 15 bp, Homo sapiens
aaaagctgtctatga

SEQ ID NO: 496824 - DNA, 15 bp, Homo sapiens
aaagctgtctatgaa

SEQ ID NO: 496825 - DNA, 15 bp, Homo sapiens
aagctgtctatgaac

SEQ ID NO: 496826 - DNA, 15 bp, Homo sapiens
agctgtctatgaact

SEQ ID NO: 496827 - DNA, 15 bp, Homo sapiens
gctgtctatgaacta

SEQ ID NO: 496828 - DNA, 15 bp, Homo sapiens
ctgtctatgaactag

SEQ ID NO: 496829 - DNA, 15 bp, Homo sapiens
tgtctatgaactaga

SEQ ID NO: 496830 - DNA, 15 bp, Homo sapiens
gtctatgaactagaa

SEQ ID NO: 496831 - DNA, 15 bp, Homo sapiens
tctatgaactagaaa

SEQ ID NO: 496832 - DNA, 15 bp, Homo sapiens
ctatgaactagaaaa

SEQ ID NO: 496833 - DNA, 15 bp, Homo sapiens
tatgaactagaaaaa

SEQ ID NO: 496834 - DNA, 15 bp, Homo sapiens
atgaactagaaaaat

SEQ ID NO: 496835 - DNA, 15 bp, Homo sapiens
tgaactagaaaaatc

SEQ ID NO: 496836 - DNA, 15 bp, Homo sapiens
gaactagaaaaatca

SEQ ID NO: 496837 - DNA, 15 bp, Homo sapiens
aactagaaaaatcat

SEQ ID NO: 496838 - DNA, 15 bp, Homo sapiens
actagaaaaatcatc

SEQ ID NO: 496839 - DNA, 15 bp, Homo sapiens
ctagaaaaatcatct

SEQ ID NO: 496840 - DNA, 15 bp, Homo sapiens
tagaaaaatcatcta

SEQ ID NO: 496841 - DNA, 15 bp, Homo sapiens
agaaaaatcatctaa

SEQ ID NO: 496842 - DNA, 15 bp, Homo sapiens
gaaaaatcatctaaa

SEQ ID NO: 496843 - DNA, 15 bp, Homo sapiens
aaaaatcatctaaaa

SEQ ID NO: 496844 - DNA, 15 bp, Homo sapiens
aaaatcatctaaaat

SEQ ID NO: 496845 - DNA, 15 bp, Homo sapiens
aaatcatctaaaata

SEQ ID NO: 496846 - DNA, 15 bp, Homo sapiens
aatcatctaaaatat

SEQ ID NO: 496847 - DNA, 15 bp, Homo sapiens
atcatctaaaatata

SEQ ID NO: 496848 - DNA, 15 bp, Homo sapiens
tcatctaaaatataa

SEQ ID NO: 496849 - DNA, 15 bp, Homo sapiens
catctaaaatataat

SEQ ID NO: 496850 - DNA, 15 bp, Homo sapiens
atctaaaatataatt

SEQ ID NO: 496851 - DNA, 15 bp, Homo sapiens
tctaaaatataattt

SEQ ID NO: 496852 - DNA, 15 bp, Homo sapiens
ctaaaatataatttg

SEQ ID NO: 496853 - DNA, 15 bp, Homo sapiens
taaaatataatttgt

SEQ ID NO: 496854 - DNA, 15 bp, Homo sapiens
aaaatataatttgtt

SEQ ID NO: 496855 - DNA, 15 bp, Homo sapiens
aaatataatttgtta

SEQ ID NO: 496856 - DNA, 15 bp, Homo sapiens
aatataatttgttaa

SEQ ID NO: 496857 - DNA, 15 bp, Homo sapiens
atataatttgttaaa

SEQ ID NO: 496858 - DNA, 15 bp, Homo sapiens
tataatttgttaaaa

SEQ ID NO: 496859 - DNA, 15 bp, Homo sapiens
ataatttgttaaaat

SEQ ID NO: 496860 - DNA, 15 bp, Homo sapiens
taatttgttaaaata

SEQ ID NO: 496861 - DNA, 15 bp, Homo sapiens
aatttgttaaaataa

SEQ ID NO: 496862 - DNA, 15 bp, Homo sapiens
atttgttaaaataaa

SEQ ID NO: 496863 - DNA, 15 bp, Homo sapiens
tttgttaaaataaag

SEQ ID NO: 496864 - DNA, 15 bp, Homo sapiens
ttgttaaaataaaga

SEQ ID NO: 496865 - DNA, 15 bp, Homo sapiens
tgttaaaataaagaa

SEQ ID NO: 496866 - DNA, 15 bp, Homo sapiens
gttaaaataaagaaa

SEQ ID NO: 496867 - DNA, 15 bp, Homo sapiens
ttaaaataaagaaaa

SEQ ID NO: 496868 - DNA, 15 bp, Homo sapiens
taaaataaagaaaac

SEQ ID NO: 496869 - DNA, 15 bp, Homo sapiens
aaaataaagaaaact

SEQ ID NO: 496870 - DNA, 15 bp, Homo sapiens
aaataaagaaaactg

SEQ ID NO: 496871 - DNA, 15 bp, Homo sapiens
aataaagaaaactga

SEQ ID NO: 496872 - DNA, 15 bp, Homo sapiens
ataaagaaaactgat

SEQ ID NO: 496873 - DNA, 15 bp, Homo sapiens
taaagaaaactgata

SEQ ID NO: 496874 - DNA, 15 bp, Homo sapiens
aaagaaaactgatac

SEQ ID NO: 496875 - DNA, 15 bp, Homo sapiens
aagaaaactgataca

SEQ ID NO: 496876 - DNA, 15 bp, Homo sapiens
agaaaactgatacat

SEQ ID NO: 496877 - DNA, 15 bp, Homo sapiens
gaaaactgatacatt

SEQ ID NO: 496878 - DNA, 15 bp, Homo sapiens
aaaactgatacattc

SEQ ID NO: 496879 - DNA, 15 bp, Homo sapiens
aaactgatacattct

SEQ ID NO: 496880 - DNA, 15 bp, Homo sapiens
aactgatacattctg

SEQ ID NO: 496881 - DNA, 15 bp, Homo sapiens
actgatacattctga

SEQ ID NO: 496882 - DNA, 15 bp, Homo sapiens
ctgatacattctgat

SEQ ID NO: 496883 - DNA, 15 bp, Homo sapiens
tgatacattctgatg

SEQ ID NO: 496884 - DNA, 15 bp, Homo sapiens
gatacattctgatga

SEQ ID NO: 496885 - DNA, 15 bp, Homo sapiens
atacattctgatgaa

SEQ ID NO: 496886 - DNA, 15 bp, Homo sapiens
tacattctgatgaac

SEQ ID NO: 496887 - DNA, 15 bp, Homo sapiens
acattctgatgaaca

SEQ ID NO: 496888 - DNA, 15 bp, Homo sapiens
cattctgatgaacaa

SEQ ID NO: 496889 - DNA, 15 bp, Homo sapiens
attctgatgaacaaa

SEQ ID NO: 496890 - DNA, 15 bp, Homo sapiens
ttctgatgaacaaac

SEQ ID NO: 496891 - DNA, 15 bp, Homo sapiens
tctgatgaacaaaca

SEQ ID NO: 496892 - DNA, 15 bp, Homo sapiens
ctgatgaacaaacat

SEQ ID NO: 496893 - DNA, 15 bp, Homo sapiens
tgatgaacaaacatt

SEQ ID NO: 496894 - DNA, 15 bp, Homo sapiens
gatgaacaaacattt

SEQ ID NO: 496895 - DNA, 15 bp, Homo sapiens
atgaacaaacatttt

SEQ ID NO: 496896 - DNA, 15 bp, Homo sapiens
tgaacaaacatttta

SEQ ID NO: 496897 - DNA, 15 bp, Homo sapiens
gaacaaacattttaa

SEQ ID NO: 496898 - DNA, 15 bp, Homo sapiens
aacaaacattttaaa

SEQ ID NO: 496899 - DNA, 15 bp, Homo sapiens
acaaacattttaaac

SEQ ID NO: 496900 - DNA, 15 bp, Homo sapiens
caaacattttaaaca

SEQ ID NO: 496901 - DNA, 15 bp, Homo sapiens
aaacattttaaacat

SEQ ID NO: 496902 - DNA, 15 bp, Homo sapiens
aacattttaaacatc

SEQ ID NO: 496903 - DNA, 15 bp, Homo sapiens
acattttaaacatcc

SEQ ID NO: 496904 - DNA, 15 bp, Homo sapiens
cattttaaacatcct

SEQ ID NO: 496905 - DNA, 15 bp, Homo sapiens
attttaaacatcctg

SEQ ID NO: 496906 - DNA, 15 bp, Homo sapiens
ttttaaacatcctgt

SEQ ID NO: 496907 - DNA, 15 bp, Homo sapiens
tttaaacatcctgtg

SEQ ID NO: 496908 - DNA, 15 bp, Homo sapiens
ttaaacatcctgtgt

SEQ ID NO: 496909 - DNA, 15 bp, Homo sapiens
taaacatcctgtgta

SEQ ID NO: 496910 - DNA, 15 bp, Homo sapiens
aaacatcctgtgtac

SEQ ID NO: 496911 - DNA, 15 bp, Homo sapiens
aacatcctgtgtacc

SEQ ID NO: 496912 - DNA, 15 bp, Homo sapiens
acatcctgtgtacca

SEQ ID NO: 496913 - DNA, 15 bp, Homo sapiens
catcctgtgtaccac

SEQ ID NO: 496914 - DNA, 15 bp, Homo sapiens
atcctgtgtaccact

SEQ ID NO: 496915 - DNA, 15 bp, Homo sapiens
tcctgtgtaccacta

SEQ ID NO: 496916 - DNA, 15 bp, Homo sapiens
cctgtgtaccactaa

SEQ ID NO: 496917 - DNA, 15 bp, Homo sapiens
ctgtgtaccactaag

SEQ ID NO: 496918 - DNA, 15 bp, Homo sapiens
tgtgtaccactaagt

SEQ ID NO: 496919 - DNA, 15 bp, Homo sapiens
gtgtaccactaagta

SEQ ID NO: 496920 - DNA, 15 bp, Homo sapiens
tgtaccactaagtaa

SEQ ID NO: 496921 - DNA, 15 bp, Homo sapiens
gtaccactaagtaat

SEQ ID NO: 496922 - DNA, 15 bp, Homo sapiens
taccactaagtaatg

SEQ ID NO: 496923 - DNA, 15 bp, Homo sapiens
accactaagtaatgc

SEQ ID NO: 496924 - DNA, 15 bp, Homo sapiens
ccactaagtaatgct

SEQ ID NO: 496925 - DNA, 15 bp, Homo sapiens
cactaagtaatgctg

SEQ ID NO: 496926 - DNA, 15 bp, Homo sapiens
actaagtaatgctga

SEQ ID NO: 496927 - DNA, 15 bp, Homo sapiens
ctaagtaatgctgac

SEQ ID NO: 496928 - DNA, 15 bp, Homo sapiens
taagtaatgctgaca

SEQ ID NO: 496929 - DNA, 15 bp, Homo sapiens
aagtaatgctgacat

SEQ ID NO: 496930 - DNA, 15 bp, Homo sapiens
agtaatgctgacatt

SEQ ID NO: 496931 - DNA, 15 bp, Homo sapiens
gtaatgctgacatta

SEQ ID NO: 496932 - DNA, 15 bp, Homo sapiens
taatgctgacattaa

SEQ ID NO: 496933 - DNA, 15 bp, Homo sapiens
aatgctgacattaag

SEQ ID NO: 496934 - DNA, 15 bp, Homo sapiens
atgctgacattaagc

SEQ ID NO: 496935 - DNA, 15 bp, Homo sapiens
tgctgacattaagca

SEQ ID NO: 496936 - DNA, 15 bp, Homo sapiens
gctgacattaagcat

SEQ ID NO: 496937 - DNA, 15 bp, Homo sapiens
ctgacattaagcatt

SEQ ID NO: 496938 - DNA, 15 bp, Homo sapiens
tgacattaagcattc

SEQ ID NO: 496939 - DNA, 15 bp, Homo sapiens
gacattaagcattcc

SEQ ID NO: 496940 - DNA, 15 bp, Homo sapiens
acattaagcattcct

SEQ ID NO: 496941 - DNA, 15 bp, Homo sapiens
cattaagcattcctg

SEQ ID NO: 496942 - DNA, 15 bp, Homo sapiens
attaagcattcctga

SEQ ID NO: 496943 - DNA, 15 bp, Homo sapiens
ttaagcattcctgaa

SEQ ID NO: 496944 - DNA, 15 bp, Homo sapiens
taagcattcctgaaa

SEQ ID NO: 496945 - DNA, 15 bp, Homo sapiens
aagcattcctgaaaa

SEQ ID NO: 496946 - DNA, 15 bp, Homo sapiens
agcattcctgaaaaa

SEQ ID NO: 496947 - DNA, 15 bp, Homo sapiens
gcattcctgaaaaaa

SEQ ID NO: 496948 - DNA, 15 bp, Homo sapiens
cattcctgaaaaaac

SEQ ID NO: 496949 - DNA, 15 bp, Homo sapiens
attcctgaaaaaaca

SEQ ID NO: 496950 - DNA, 15 bp, Homo sapiens
ttcctgaaaaaacac

SEQ ID NO: 496951 - DNA, 15 bp, Homo sapiens
tcctgaaaaaacact

SEQ ID NO: 496952 - DNA, 15 bp, Homo sapiens
cctgaaaaaacactt

SEQ ID NO: 496953 - DNA, 15 bp, Homo sapiens
ctgaaaaaacacttg

SEQ ID NO: 496954 - DNA, 15 bp, Homo sapiens
tgaaaaaacacttga

SEQ ID NO: 496955 - DNA, 15 bp, Homo sapiens
gaaaaaacacttgat

SEQ ID NO: 496956 - DNA, 15 bp, Homo sapiens
aaaaaacacttgatt

SEQ ID NO: 496957 - DNA, 15 bp, Homo sapiens
aaaaacacttgattt

SEQ ID NO: 496958 - DNA, 15 bp, Homo sapiens
aaaacacttgatttc

SEQ ID NO: 496959 - DNA, 15 bp, Homo sapiens
aaacacttgatttcc

SEQ ID NO: 496960 - DNA, 15 bp, Homo sapiens
aacacttgatttcca

SEQ ID NO: 496961 - DNA, 15 bp, Homo sapiens
acacttgatttccag

SEQ ID NO: 496962 - DNA, 15 bp, Homo sapiens
cacttgatttccagc

SEQ ID NO: 496963 - DNA, 15 bp, Homo sapiens
acttgatttccagca

SEQ ID NO: 496964 - DNA, 15 bp, Homo sapiens
cttgatttccagcaa

SEQ ID NO: 496965 - DNA, 15 bp, Homo sapiens
ttgatttccagcaac

SEQ ID NO: 496966 - DNA, 15 bp, Homo sapiens
tgatttccagcaact

SEQ ID NO: 496967 - DNA, 15 bp, Homo sapiens
gatttccagcaactt

SEQ ID NO: 496968 - DNA, 15 bp, Homo sapiens
atttccagcaacttg

SEQ ID NO: 496969 - DNA, 15 bp, Homo sapiens
tttccagcaacttgt

SEQ ID NO: 496970 - DNA, 15 bp, Homo sapiens
ttccagcaacttgtt

SEQ ID NO: 496971 - DNA, 15 bp, Homo sapiens
tccagcaacttgttg

SEQ ID NO: 496972 - DNA, 15 bp, Homo sapiens
ccagcaacttgttga

SEQ ID NO: 496973 - DNA, 15 bp, Homo sapiens
cagcaacttgttgac

SEQ ID NO: 496974 - DNA, 15 bp, Homo sapiens
agcaacttgttgact

SEQ ID NO: 496975 - DNA, 15 bp, Homo sapiens
gcaacttgttgacta

SEQ ID NO: 496976 - DNA, 15 bp, Homo sapiens
caacttgttgactag

SEQ ID NO: 496977 - DNA, 15 bp, Homo sapiens
aacttgttgactagg

SEQ ID NO: 496978 - DNA, 15 bp, Homo sapiens
acttgttgactaggt

SEQ ID NO: 496979 - DNA, 15 bp, Homo sapiens
cttgttgactaggta

SEQ ID NO: 496980 - DNA, 15 bp, Homo sapiens
ttgttgactaggtag

SEQ ID NO: 496981 - DNA, 15 bp, Homo sapiens
tgttgactaggtagc

SEQ ID NO: 496982 - DNA, 15 bp, Homo sapiens
gttgactaggtagct

SEQ ID NO: 496983 - DNA, 15 bp, Homo sapiens
ttgactaggtagctg

SEQ ID NO: 496984 - DNA, 15 bp, Homo sapiens
tgactaggtagctga

SEQ ID NO: 496985 - DNA, 15 bp, Homo sapiens
gactaggtagctgaa

SEQ ID NO: 496986 - DNA, 15 bp, Homo sapiens
actaggtagctgaaa

SEQ ID NO: 496987 - DNA, 15 bp, Homo sapiens
ctaggtagctgaaaa

SEQ ID NO: 496988 - DNA, 15 bp, Homo sapiens
taggtagctgaaaat

SEQ ID NO: 496989 - DNA, 15 bp, Homo sapiens
aggtagctgaaaata

SEQ ID NO: 496990 - DNA, 15 bp, Homo sapiens
ggtagctgaaaatag

SEQ ID NO: 496991 - DNA, 15 bp, Homo sapiens
gtagctgaaaataga

SEQ ID NO: 496992 - DNA, 15 bp, Homo sapiens
tagctgaaaatagaa

SEQ ID NO: 496993 - DNA, 15 bp, Homo sapiens
agctgaaaatagaag

SEQ ID NO: 496994 - DNA, 15 bp, Homo sapiens
gctgaaaatagaagt

SEQ ID NO: 496995 - DNA, 15 bp, Homo sapiens
ctgaaaatagaagtg

SEQ ID NO: 496996 - DNA, 15 bp, Homo sapiens
tgaaaatagaagtgc

SEQ ID NO: 496997 - DNA, 15 bp, Homo sapiens
gaaaatagaagtgcg

SEQ ID NO: 496998 - DNA, 15 bp, Homo sapiens
aaaatagaagtgcga

SEQ ID NO: 496999 - DNA, 15 bp, Homo sapiens
aaatagaagtgcgaa

SEQ ID NO: 497000 - DNA, 15 bp, Homo sapiens
aatagaagtgcgaac

SEQ ID NO: 497001 - DNA, 15 bp, Homo sapiens
atagaagtgcgaaca

SEQ ID NO: 497002 - DNA, 15 bp, Homo sapiens
tagaagtgcgaacaa

SEQ ID NO: 497003 - DNA, 15 bp, Homo sapiens
agaagtgcgaacaaa

SEQ ID NO: 497004 - DNA, 15 bp, Homo sapiens
gaagtgcgaacaaat

SEQ ID NO: 497005 - DNA, 15 bp, Homo sapiens
aagtgcgaacaaatg

SEQ ID NO: 497006 - DNA, 15 bp, Homo sapiens
agtgcgaacaaatga

SEQ ID NO: 497007 - DNA, 15 bp, Homo sapiens
gtgcgaacaaatgaa

SEQ ID NO: 497008 - DNA, 15 bp, Homo sapiens
tgcgaacaaatgaac

SEQ ID NO: 497009 - DNA, 15 bp, Homo sapiens
gcgaacaaatgaaca

SEQ ID NO: 497010 - DNA, 15 bp, Homo sapiens
cgaacaaatgaacaa

SEQ ID NO: 497011 - DNA, 15 bp, Homo sapiens
gaacaaatgaacaag

SEQ ID NO: 497012 - DNA, 15 bp, Homo sapiens
aacaaatgaacaagt

SEQ ID NO: 497013 - DNA, 15 bp, Homo sapiens
acaaatgaacaagtt

SEQ ID NO: 497014 - DNA, 15 bp, Homo sapiens
caaatgaacaagttt

SEQ ID NO: 497015 - DNA, 15 bp, Homo sapiens
aaatgaacaagtttt

SEQ ID NO: 497016 - DNA, 15 bp, Homo sapiens
aatgaacaagttttg

SEQ ID NO: 497017 - DNA, 15 bp, Homo sapiens
atgaacaagttttgc

SEQ ID NO: 497018 - DNA, 15 bp, Homo sapiens
tgaacaagttttgct

SEQ ID NO: 497019 - DNA, 15 bp, Homo sapiens
gaacaagttttgctt

SEQ ID NO: 497020 - DNA, 15 bp, Homo sapiens
aacaagttttgcttt

SEQ ID NO: 497021 - DNA, 15 bp, Homo sapiens
acaagttttgctttc

SEQ ID NO: 497022 - DNA, 15 bp, Homo sapiens
caagttttgctttca

SEQ ID NO: 497023 - DNA, 15 bp, Homo sapiens
aagttttgctttcat

SEQ ID NO: 497024 - DNA, 15 bp, Homo sapiens
agttttgctttcata

SEQ ID NO: 497025 - DNA, 15 bp, Homo sapiens
gttttgctttcatac

SEQ ID NO: 497026 - DNA, 15 bp, Homo sapiens
ttttgctttcatact

SEQ ID NO: 497027 - DNA, 15 bp, Homo sapiens
tttgctttcatactg

SEQ ID NO: 497028 - DNA, 15 bp, Homo sapiens
ttgctttcatactgc

SEQ ID NO: 497029 - DNA, 15 bp, Homo sapiens
tgctttcatactgct

SEQ ID NO: 497030 - DNA, 15 bp, Homo sapiens
gctttcatactgctg

SEQ ID NO: 497031 - DNA, 15 bp, Homo sapiens
ctttcatactgctgt

SEQ ID NO: 497032 - DNA, 15 bp, Homo sapiens
tttcatactgctgtg

SEQ ID NO: 497033 - DNA, 15 bp, Homo sapiens
ttcatactgctgtgg

SEQ ID NO: 497034 - DNA, 15 bp, Homo sapiens
tcatactgctgtggt

SEQ ID NO: 497035 - DNA, 15 bp, Homo sapiens
catactgctgtggtt

SEQ ID NO: 497036 - DNA, 15 bp, Homo sapiens
atactgctgtggttt

SEQ ID NO: 497037 - DNA, 15 bp, Homo sapiens
tactgctgtggtttg

SEQ ID NO: 497038 - DNA, 15 bp, Homo sapiens
actgctgtggtttga

SEQ ID NO: 497039 - DNA, 15 bp, Homo sapiens
ctgctgtggtttgaa

SEQ ID NO: 497040 - DNA, 15 bp, Homo sapiens
tgctgtggtttgaat

SEQ ID NO: 497041 - DNA, 15 bp, Homo sapiens
gctgtggtttgaatg

SEQ ID NO: 497042 - DNA, 15 bp, Homo sapiens
ctgtggtttgaatgt

SEQ ID NO: 497043 - DNA, 15 bp, Homo sapiens
tgtggtttgaatgtg

SEQ ID NO: 497044 - DNA, 15 bp, Homo sapiens
gtggtttgaatgtgt

SEQ ID NO: 497045 - DNA, 15 bp, Homo sapiens
tggtttgaatgtgtc

SEQ ID NO: 497046 - DNA, 15 bp, Homo sapiens
ggtttgaatgtgtca

SEQ ID NO: 497047 - DNA, 15 bp, Homo sapiens
gtttgaatgtgtcac

SEQ ID NO: 497048 - DNA, 15 bp, Homo sapiens
ttgaatgtgtcaccc

SEQ ID NO: 497049 - DNA, 15 bp, Homo sapiens
tgaatgtgtcaccca

SEQ ID NO: 497050 - DNA, 15 bp, Homo sapiens
gaatgtgtcacccac

SEQ ID NO: 497051 - DNA, 15 bp, Homo sapiens
aatgtgtcacccaca

SEQ ID NO: 497052 - DNA, 15 bp, Homo sapiens
atgtgtcacccacag

SEQ ID NO: 497053 - DNA, 15 bp, Homo sapiens
tgtgtcacccacagt

SEQ ID NO: 497054 - DNA, 15 bp, Homo sapiens
gtgtcacccacagtt

SEQ ID NO: 497055 - DNA, 15 bp, Homo sapiens
tgtcacccacagttc

SEQ ID NO: 497056 - DNA, 15 bp, Homo sapiens
gtcacccacagttca

SEQ ID NO: 497057 - DNA, 15 bp, Homo sapiens
tcacccacagttcat

SEQ ID NO: 497058 - DNA, 15 bp, Homo sapiens
cacccacagttcatg

SEQ ID NO: 497059 - DNA, 15 bp, Homo sapiens
acccacagttcatgt

SEQ ID NO: 497060 - DNA, 15 bp, Homo sapiens
cccacagttcatgtg

SEQ ID NO: 497061 - DNA, 15 bp, Homo sapiens
ccacagttcatgtgt

SEQ ID NO: 497062 - DNA, 15 bp, Homo sapiens
cacagttcatgtgtt

SEQ ID NO: 497063 - DNA, 15 bp, Homo sapiens
acagttcatgtgttg

SEQ ID NO: 497064 - DNA, 15 bp, Homo sapiens
cagttcatgtgttga

SEQ ID NO: 497065 - DNA, 15 bp, Homo sapiens
agttcatgtgttgaa

SEQ ID NO: 497066 - DNA, 15 bp, Homo sapiens
gttcatgtgttgaaa

SEQ ID NO: 497067 - DNA, 15 bp, Homo sapiens
ttcatgtgttgaaaa

SEQ ID NO: 497068 - DNA, 15 bp, Homo sapiens
tcatgtgttgaaaat

SEQ ID NO: 497069 - DNA, 15 bp, Homo sapiens
catgtgttgaaaatt

SEQ ID NO: 497070 - DNA, 15 bp, Homo sapiens
atgtgttgaaaattt

SEQ ID NO: 497071 - DNA, 15 bp, Homo sapiens
tgtgttgaaaattta

SEQ ID NO: 497072 - DNA, 15 bp, Homo sapiens
gtgttgaaaatttaa

SEQ ID NO: 497073 - DNA, 15 bp, Homo sapiens
tgttgaaaatttaat

SEQ ID NO: 497074 - DNA, 15 bp, Homo sapiens
gttgaaaatttaatc

SEQ ID NO: 497075 - DNA, 15 bp, Homo sapiens
ttgaaaatttaatcc

SEQ ID NO: 497076 - DNA, 15 bp, Homo sapiens
tgaaaatttaatccc

SEQ ID NO: 497077 - DNA, 15 bp, Homo sapiens
gaaaatttaatcccc

SEQ ID NO: 497078 - DNA, 15 bp, Homo sapiens
aaaatttaatccccg

SEQ ID NO: 497079 - DNA, 15 bp, Homo sapiens
aaatttaatccccga

SEQ ID NO: 497080 - DNA, 15 bp, Homo sapiens
aatttaatccccgat

SEQ ID NO: 497081 - DNA, 15 bp, Homo sapiens
atttaatccccgatt

SEQ ID NO: 497082 - DNA, 15 bp, Homo sapiens
tttaatccccgattc

SEQ ID NO: 497083 - DNA, 15 bp, Homo sapiens
ttaatccccgattcc

SEQ ID NO: 497084 - DNA, 15 bp, Homo sapiens
taatccccgattcca

SEQ ID NO: 497085 - DNA, 15 bp, Homo sapiens
aatccccgattccat

SEQ ID NO: 497086 - DNA, 15 bp, Homo sapiens
atccccgattccata

SEQ ID NO: 497087 - DNA, 15 bp, Homo sapiens
tccccgattccatag

SEQ ID NO: 497088 - DNA, 15 bp, Homo sapiens
ccccgattccatagt

SEQ ID NO: 497089 - DNA, 15 bp, Homo sapiens
cccgattccatagtg

SEQ ID NO: 497090 - DNA, 15 bp, Homo sapiens
ccgattccatagtgt

SEQ ID NO: 497091 - DNA, 15 bp, Homo sapiens
cgattccatagtgtt

SEQ ID NO: 497092 - DNA, 15 bp, Homo sapiens
gattccatagtgttg

SEQ ID NO: 497093 - DNA, 15 bp, Homo sapiens
attccatagtgttga

SEQ ID NO: 497094 - DNA, 15 bp, Homo sapiens
ttccatagtgttgag

SEQ ID NO: 497095 - DNA, 15 bp, Homo sapiens
tccatagtgttgagg

SEQ ID NO: 497096 - DNA, 15 bp, Homo sapiens
ccatagtgttgaggg

SEQ ID NO: 497097 - DNA, 15 bp, Homo sapiens
atagtgttgaggggt

SEQ ID NO: 497098 - DNA, 15 bp, Homo sapiens
tagtgttgaggggtt

SEQ ID NO: 497099 - DNA, 15 bp, Homo sapiens
agtgttgaggggttg

SEQ ID NO: 497100 - DNA, 15 bp, Homo sapiens
gtgttgaggggttgg

SEQ ID NO: 497101 - DNA, 15 bp, Homo sapiens
tgttgaggggttgga

SEQ ID NO: 497102 - DNA, 15 bp, Homo sapiens
gttgaggggttggac

SEQ ID NO: 497103 - DNA, 15 bp, Homo sapiens
ttgaggggttggacc

SEQ ID NO: 497104 - DNA, 15 bp, Homo sapiens
tgaggggttggacct

SEQ ID NO: 497105 - DNA, 15 bp, Homo sapiens
gaggggttggacctt

SEQ ID NO: 497106 - DNA, 15 bp, Homo sapiens
aggggttggaccttt

SEQ ID NO: 497107 - DNA, 15 bp, Homo sapiens
ggggttggaccttta

SEQ ID NO: 497108 - DNA, 15 bp, Homo sapiens
gggttggacctttaa

SEQ ID NO: 497109 - DNA, 15 bp, Homo sapiens
ggttggacctttaag

SEQ ID NO: 497110 - DNA, 15 bp, Homo sapiens
gttggacctttaaga

SEQ ID NO: 497111 - DNA, 15 bp, Homo sapiens
ttggacctttaagaa

SEQ ID NO: 497112 - DNA, 15 bp, Homo sapiens
tggacctttaagaag

SEQ ID NO: 497113 - DNA, 15 bp, Homo sapiens
ggacctttaagaagt

SEQ ID NO: 497114 - DNA, 15 bp, Homo sapiens
gacctttaagaagtg

SEQ ID NO: 497115 - DNA, 15 bp, Homo sapiens
acctttaagaagtga

SEQ ID NO: 497116 - DNA, 15 bp, Homo sapiens
cctttaagaagtgat

SEQ ID NO: 497117 - DNA, 15 bp, Homo sapiens
ctttaagaagtgatt

SEQ ID NO: 497118 - DNA, 15 bp, Homo sapiens
tttaagaagtgattg

SEQ ID NO: 497119 - DNA, 15 bp, Homo sapiens
ttaagaagtgattgg

SEQ ID NO: 497120 - DNA, 15 bp, Homo sapiens
taagaagtgattgga

SEQ ID NO: 497121 - DNA, 15 bp, Homo sapiens
aagaagtgattggat

SEQ ID NO: 497122 - DNA, 15 bp, Homo sapiens
agaagtgattggatc

SEQ ID NO: 497123 - DNA, 15 bp, Homo sapiens
gaagtgattggatca

SEQ ID NO: 497124 - DNA, 15 bp, Homo sapiens
aagtgattggatcat

SEQ ID NO: 497125 - DNA, 15 bp, Homo sapiens
agtgattggatcatg

SEQ ID NO: 497126 - DNA, 15 bp, Homo sapiens
gtgattggatcatga

SEQ ID NO: 497127 - DNA, 15 bp, Homo sapiens
tgattggatcatgag

SEQ ID NO: 497128 - DNA, 15 bp, Homo sapiens
gattggatcatgagg

SEQ ID NO: 497129 - DNA, 15 bp, Homo sapiens
attggatcatgaggt

SEQ ID NO: 497130 - DNA, 15 bp, Homo sapiens
ttggatcatgaggtc

SEQ ID NO: 497131 - DNA, 15 bp, Homo sapiens
gatcatgaggtcaga

SEQ ID NO: 497132 - DNA, 15 bp, Homo sapiens
atcatgaggtcagag

SEQ ID NO: 497133 - DNA, 15 bp, Homo sapiens
tcatgaggtcagagg

SEQ ID NO: 497134 - DNA, 15 bp, Homo sapiens
catgaggtcagaggt

SEQ ID NO: 497135 - DNA, 15 bp, Homo sapiens
atgaggtcagaggtc

SEQ ID NO: 497136 - DNA, 15 bp, Homo sapiens
tgaggtcagaggtca

SEQ ID NO: 497137 - DNA, 15 bp, Homo sapiens
gaggtcagaggtcat

SEQ ID NO: 497138 - DNA, 15 bp, Homo sapiens
aggtcagaggtcatg

SEQ ID NO: 497139 - DNA, 15 bp, Homo sapiens
ggtcagaggtcatga

SEQ ID NO: 497140 - DNA, 15 bp, Homo sapiens
gtcagaggtcatgaa

SEQ ID NO: 497141 - DNA, 15 bp, Homo sapiens
tcagaggtcatgaat

SEQ ID NO: 497142 - DNA, 15 bp, Homo sapiens
cagaggtcatgaatg

SEQ ID NO: 497143 - DNA, 15 bp, Homo sapiens
agaggtcatgaatgg

SEQ ID NO: 497144 - DNA, 15 bp, Homo sapiens
gaggtcatgaatgga

SEQ ID NO: 497145 - DNA, 15 bp, Homo sapiens
aggtcatgaatggat

SEQ ID NO: 497146 - DNA, 15 bp, Homo sapiens
ggtcatgaatggatt

SEQ ID NO: 497147 - DNA, 15 bp, Homo sapiens
gtcatgaatggatta

SEQ ID NO: 497148 - DNA, 15 bp, Homo sapiens
tcatgaatggattaa

SEQ ID NO: 497149 - DNA, 15 bp, Homo sapiens
catgaatggattaat

SEQ ID NO: 497150 - DNA, 15 bp, Homo sapiens
atgaatggattaatg

SEQ ID NO: 497151 - DNA, 15 bp, Homo sapiens
tggattaatgtcatc

SEQ ID NO: 497152 - DNA, 15 bp, Homo sapiens
ggattaatgtcatca

SEQ ID NO: 497153 - DNA, 15 bp, Homo sapiens
gattaatgtcatcac

SEQ ID NO: 497154 - DNA, 15 bp, Homo sapiens
attaatgtcatcaca

SEQ ID NO: 497155 - DNA, 15 bp, Homo sapiens
ttaatgtcatcacag

SEQ ID NO: 497156 - DNA, 15 bp, Homo sapiens
taatgtcatcacaga

SEQ ID NO: 497157 - DNA, 15 bp, Homo sapiens
aatgtcatcacagaa

SEQ ID NO: 497158 - DNA, 15 bp, Homo sapiens
atgtcatcacagaag

SEQ ID NO: 497159 - DNA, 15 bp, Homo sapiens
tgtcatcacagaagt

SEQ ID NO: 497160 - DNA, 15 bp, Homo sapiens
gtcatcacagaagtg

SEQ ID NO: 497161 - DNA, 15 bp, Homo sapiens
tcatcacagaagtgt

SEQ ID NO: 497162 - DNA, 15 bp, Homo sapiens
catcacagaagtgtg

SEQ ID NO: 497163 - DNA, 15 bp, Homo sapiens
atcacagaagtgtgt

SEQ ID NO: 497164 - DNA, 15 bp, Homo sapiens
tcacagaagtgtgtt

SEQ ID NO: 497165 - DNA, 15 bp, Homo sapiens
cacagaagtgtgttt

SEQ ID NO: 497166 - DNA, 15 bp, Homo sapiens
acagaagtgtgtttg

SEQ ID NO: 497167 - DNA, 15 bp, Homo sapiens
cagaagtgtgtttgc

SEQ ID NO: 497168 - DNA, 15 bp, Homo sapiens
agaagtgtgtttgct

SEQ ID NO: 497169 - DNA, 15 bp, Homo sapiens
gaagtgtgtttgcta

SEQ ID NO: 497170 - DNA, 15 bp, Homo sapiens
aagtgtgtttgctat

SEQ ID NO: 497171 - DNA, 15 bp, Homo sapiens
agtgtgtttgctatc

SEQ ID NO: 497172 - DNA, 15 bp, Homo sapiens
gtgtgtttgctatct

SEQ ID NO: 497173 - DNA, 15 bp, Homo sapiens
tgtgtttgctatctc

SEQ ID NO: 497174 - DNA, 15 bp, Homo sapiens
gtgtttgctatctca

SEQ ID NO: 497175 - DNA, 15 bp, Homo sapiens
tgtttgctatctcaa

SEQ ID NO: 497176 - DNA, 15 bp, Homo sapiens
gtttgctatctcaag

SEQ ID NO: 497177 - DNA, 15 bp, Homo sapiens
tttgctatctcaagt

SEQ ID NO: 497178 - DNA, 15 bp, Homo sapiens
ttgctatctcaagtg

SEQ ID NO: 497179 - DNA, 15 bp, Homo sapiens
tgctatctcaagtgg

SEQ ID NO: 497180 - DNA, 15 bp, Homo sapiens
gctatctcaagtggg

SEQ ID NO: 497181 - DNA, 15 bp, Homo sapiens
ctatctcaagtgggt

SEQ ID NO: 497182 - DNA, 15 bp, Homo sapiens
tatctcaagtgggtt

SEQ ID NO: 497183 - DNA, 15 bp, Homo sapiens
atctcaagtgggttt

SEQ ID NO: 497184 - DNA, 15 bp, Homo sapiens
tctcaagtgggttta

SEQ ID NO: 497185 - DNA, 15 bp, Homo sapiens
ctcaagtgggtttat

SEQ ID NO: 497186 - DNA, 15 bp, Homo sapiens
tcaagtgggtttatt

SEQ ID NO: 497187 - DNA, 15 bp, Homo sapiens
caagtgggtttatta

SEQ ID NO: 497188 - DNA, 15 bp, Homo sapiens
aagtgggtttattac

SEQ ID NO: 497189 - DNA, 15 bp, Homo sapiens
agtgggtttattacc

SEQ ID NO: 497190 - DNA, 15 bp, Homo sapiens
gtgggtttattacca

SEQ ID NO: 497191 - DNA, 15 bp, Homo sapiens
tgggtttattaccaa

SEQ ID NO: 497192 - DNA, 15 bp, Homo sapiens
gggtttattaccaaa

SEQ ID NO: 497193 - DNA, 15 bp, Homo sapiens
ggtttattaccaaag

SEQ ID NO: 497194 - DNA, 15 bp, Homo sapiens
gtttattaccaaagc

SEQ ID NO: 497195 - DNA, 15 bp, Homo sapiens
tttattaccaaagca

SEQ ID NO: 497196 - DNA, 15 bp, Homo sapiens
ttattaccaaagcac

SEQ ID NO: 497197 - DNA, 15 bp, Homo sapiens
tattaccaaagcacg

SEQ ID NO: 497198 - DNA, 15 bp, Homo sapiens
attaccaaagcacgt

SEQ ID NO: 497199 - DNA, 15 bp, Homo sapiens
ttaccaaagcacgtt

SEQ ID NO: 497200 - DNA, 15 bp, Homo sapiens
taccaaagcacgttg

SEQ ID NO: 497201 - DNA, 15 bp, Homo sapiens
accaaagcacgttgg

SEQ ID NO: 497202 - DNA, 15 bp, Homo sapiens
ccaaagcacgttggg

SEQ ID NO: 497203 - DNA, 15 bp, Homo sapiens
caaagcacgttgggt

SEQ ID NO: 497204 - DNA, 15 bp, Homo sapiens
aaagcacgttgggtt

SEQ ID NO: 497205 - DNA, 15 bp, Homo sapiens
aagcacgttgggttc

SEQ ID NO: 497206 - DNA, 15 bp, Homo sapiens
agcacgttgggttct

SEQ ID NO: 497207 - DNA, 15 bp, Homo sapiens
gcacgttgggttctc

SEQ ID NO: 497208 - DNA, 15 bp, Homo sapiens
cacgttgggttctct

SEQ ID NO: 497209 - DNA, 15 bp, Homo sapiens
acgttgggttctctc

SEQ ID NO: 497210 - DNA, 15 bp, Homo sapiens
cgttgggttctctca

SEQ ID NO: 497211 - DNA, 15 bp, Homo sapiens
gttgggttctctcac

SEQ ID NO: 497212 - DNA, 15 bp, Homo sapiens
ttgggttctctcact

SEQ ID NO: 497213 - DNA, 15 bp, Homo sapiens
tgggttctctcactt

SEQ ID NO: 497214 - DNA, 15 bp, Homo sapiens
gggttctctcacttt

SEQ ID NO: 497215 - DNA, 15 bp, Homo sapiens
ggttctctcactttc

SEQ ID NO: 497216 - DNA, 15 bp, Homo sapiens
gttctctcactttct

SEQ ID NO: 497217 - DNA, 15 bp, Homo sapiens
ttctctcactttctc

SEQ ID NO: 497218 - DNA, 15 bp, Homo sapiens
tctctcactttctct

SEQ ID NO: 497219 - DNA, 15 bp, Homo sapiens
ctctcactttctctt

SEQ ID NO: 497220 - DNA, 15 bp, Homo sapiens
tctcactttctcttg

SEQ ID NO: 497221 - DNA, 15 bp, Homo sapiens
ctcactttctcttgc

SEQ ID NO: 497222 - DNA, 15 bp, Homo sapiens
tcactttctcttgca

SEQ ID NO: 497223 - DNA, 15 bp, Homo sapiens
cactttctcttgcat

SEQ ID NO: 497224 - DNA, 15 bp, Homo sapiens
actttctcttgcatg

SEQ ID NO: 497225 - DNA, 15 bp, Homo sapiens
ctttctcttgcatgt

SEQ ID NO: 497226 - DNA, 15 bp, Homo sapiens
tttctcttgcatgtt

SEQ ID NO: 497227 - DNA, 15 bp, Homo sapiens
ttctcttgcatgttc

SEQ ID NO: 497228 - DNA, 15 bp, Homo sapiens
tctcttgcatgttct

SEQ ID NO: 497229 - DNA, 15 bp, Homo sapiens
ctcttgcatgttctc

SEQ ID NO: 497230 - DNA, 15 bp, Homo sapiens
tcttgcatgttctct

SEQ ID NO: 497231 - DNA, 15 bp, Homo sapiens
cttgcatgttctctg

SEQ ID NO: 497232 - DNA, 15 bp, Homo sapiens
ttgcatgttctctgc

SEQ ID NO: 497233 - DNA, 15 bp, Homo sapiens
tgcatgttctctgcc

SEQ ID NO: 497234 - DNA, 15 bp, Homo sapiens
gcatgttctctgccc

SEQ ID NO: 497235 - DNA, 15 bp, Homo sapiens
catgttctctgccct

SEQ ID NO: 497236 - DNA, 15 bp, Homo sapiens
atgttctctgccctg

SEQ ID NO: 497237 - DNA, 15 bp, Homo sapiens
tgttctctgccctgt

SEQ ID NO: 497238 - DNA, 15 bp, Homo sapiens
gttctctgccctgtc

SEQ ID NO: 497239 - DNA, 15 bp, Homo sapiens
ttctctgccctgtca

SEQ ID NO: 497240 - DNA, 15 bp, Homo sapiens
tctctgccctgtcac

SEQ ID NO: 497241 - DNA, 15 bp, Homo sapiens
ctctgccctgtcacc

SEQ ID NO: 497242 - DNA, 15 bp, Homo sapiens
tctgccctgtcacct

SEQ ID NO: 497243 - DNA, 15 bp, Homo sapiens
ctgccctgtcacctt

SEQ ID NO: 497244 - DNA, 15 bp, Homo sapiens
tgccctgtcaccttc

SEQ ID NO: 497245 - DNA, 15 bp, Homo sapiens
gccctgtcaccttcc

SEQ ID NO: 497246 - DNA, 15 bp, Homo sapiens
ccctgtcaccttcca

SEQ ID NO: 497247 - DNA, 15 bp, Homo sapiens
cctgtcaccttccac

SEQ ID NO: 497248 - DNA, 15 bp, Homo sapiens
ctgtcaccttccacc

SEQ ID NO: 497249 - DNA, 15 bp, Homo sapiens
tgtcaccttccacca

SEQ ID NO: 497250 - DNA, 15 bp, Homo sapiens
gtcaccttccaccat

SEQ ID NO: 497251 - DNA, 15 bp, Homo sapiens
tcaccttccaccata

SEQ ID NO: 497252 - DNA, 15 bp, Homo sapiens
caccttccaccatag

SEQ ID NO: 497253 - DNA, 15 bp, Homo sapiens
accttccaccatagg

SEQ ID NO: 497254 - DNA, 15 bp, Homo sapiens
ccttccaccatagga

SEQ ID NO: 497255 - DNA, 15 bp, Homo sapiens
cttccaccataggat

SEQ ID NO: 497256 - DNA, 15 bp, Homo sapiens
ttccaccataggatg

SEQ ID NO: 497257 - DNA, 15 bp, Homo sapiens
tccaccataggatga

SEQ ID NO: 497258 - DNA, 15 bp, Homo sapiens
ccaccataggatgac

SEQ ID NO: 497259 - DNA, 15 bp, Homo sapiens
caccataggatgacg

SEQ ID NO: 497260 - DNA, 15 bp, Homo sapiens
accataggatgacgc

SEQ ID NO: 497261 - DNA, 15 bp, Homo sapiens
ccataggatgacgca

SEQ ID NO: 497262 - DNA, 15 bp, Homo sapiens
cataggatgacgcag

SEQ ID NO: 497263 - DNA, 15 bp, Homo sapiens
ataggatgacgcagc

SEQ ID NO: 497264 - DNA, 15 bp, Homo sapiens
taggatgacgcagca

SEQ ID NO: 497265 - DNA, 15 bp, Homo sapiens
aggatgacgcagcaa

SEQ ID NO: 497266 - DNA, 15 bp, Homo sapiens
ggatgacgcagcaag

SEQ ID NO: 497267 - DNA, 15 bp, Homo sapiens
gatgacgcagcaaga

SEQ ID NO: 497268 - DNA, 15 bp, Homo sapiens
atgacgcagcaagac

SEQ ID NO: 497269 - DNA, 15 bp, Homo sapiens
tgacgcagcaagaca

SEQ ID NO: 497270 - DNA, 15 bp, Homo sapiens
gacgcagcaagacag

SEQ ID NO: 497271 - DNA, 15 bp, Homo sapiens
acgcagcaagacagg

SEQ ID NO: 497272 - DNA, 15 bp, Homo sapiens
cgcagcaagacaggc

SEQ ID NO: 497273 - DNA, 15 bp, Homo sapiens
gcagcaagacaggcc

SEQ ID NO: 497274 - DNA, 15 bp, Homo sapiens
cagcaagacaggcct

SEQ ID NO: 497275 - DNA, 15 bp, Homo sapiens
agcaagacaggcctt

SEQ ID NO: 497276 - DNA, 15 bp, Homo sapiens
gcaagacaggcctta

SEQ ID NO: 497277 - DNA, 15 bp, Homo sapiens
caagacaggccttac

SEQ ID NO: 497278 - DNA, 15 bp, Homo sapiens
aagacaggccttacc

SEQ ID NO: 497279 - DNA, 15 bp, Homo sapiens
agacaggccttacca

SEQ ID NO: 497280 - DNA, 15 bp, Homo sapiens
gacaggccttaccag

SEQ ID NO: 497281 - DNA, 15 bp, Homo sapiens
acaggccttaccaga

SEQ ID NO: 497282 - DNA, 15 bp, Homo sapiens
caggccttaccagat

SEQ ID NO: 497283 - DNA, 15 bp, Homo sapiens
aggccttaccagatg

SEQ ID NO: 497284 - DNA, 15 bp, Homo sapiens
ggccttaccagatgc

SEQ ID NO: 497285 - DNA, 15 bp, Homo sapiens
gccttaccagatgct

SEQ ID NO: 497286 - DNA, 15 bp, Homo sapiens
ccttaccagatgctg

SEQ ID NO: 497287 - DNA, 15 bp, Homo sapiens
cttaccagatgctgg

SEQ ID NO: 497288 - DNA, 15 bp, Homo sapiens
ttaccagatgctggc

SEQ ID NO: 497289 - DNA, 15 bp, Homo sapiens
taccagatgctggca

SEQ ID NO: 497290 - DNA, 15 bp, Homo sapiens
accagatgctggcac

SEQ ID NO: 497291 - DNA, 15 bp, Homo sapiens
ccagatgctggcacc

SEQ ID NO: 497292 - DNA, 15 bp, Homo sapiens
cagatgctggcacct

SEQ ID NO: 497293 - DNA, 15 bp, Homo sapiens
agatgctggcacctt

SEQ ID NO: 497294 - DNA, 15 bp, Homo sapiens
gatgctggcaccttg

SEQ ID NO: 497295 - DNA, 15 bp, Homo sapiens
atgctggcaccttga

SEQ ID NO: 497296 - DNA, 15 bp, Homo sapiens
tgctggcaccttgat

SEQ ID NO: 497297 - DNA, 15 bp, Homo sapiens
gctggcaccttgata

SEQ ID NO: 497298 - DNA, 15 bp, Homo sapiens
ctggcaccttgatat

SEQ ID NO: 497299 - DNA, 15 bp, Homo sapiens
tggcaccttgatatt

SEQ ID NO: 497300 - DNA, 15 bp, Homo sapiens
ggcaccttgatattg

SEQ ID NO: 497301 - DNA, 15 bp, Homo sapiens
gcaccttgatattgg

SEQ ID NO: 497302 - DNA, 15 bp, Homo sapiens
caccttgatattgga

SEQ ID NO: 497303 - DNA, 15 bp, Homo sapiens
accttgatattggac

SEQ ID NO: 497304 - DNA, 15 bp, Homo sapiens
ccttgatattggact

SEQ ID NO: 497305 - DNA, 15 bp, Homo sapiens
cttgatattggactt

SEQ ID NO: 497306 - DNA, 15 bp, Homo sapiens
ttgatattggacttc

SEQ ID NO: 497307 - DNA, 15 bp, Homo sapiens
tgatattggacttcc

SEQ ID NO: 497308 - DNA, 15 bp, Homo sapiens
gatattggacttccc

SEQ ID NO: 497309 - DNA, 15 bp, Homo sapiens
atattggacttccca

SEQ ID NO: 497310 - DNA, 15 bp, Homo sapiens
tattggacttcccaa

SEQ ID NO: 497311 - DNA, 15 bp, Homo sapiens
attggacttcccaac

SEQ ID NO: 497312 - DNA, 15 bp, Homo sapiens
ttggacttcccaacc

SEQ ID NO: 497313 - DNA, 15 bp, Homo sapiens
tggacttcccaacct

SEQ ID NO: 497314 - DNA, 15 bp, Homo sapiens
ggacttcccaacctc

SEQ ID NO: 497315 - DNA, 15 bp, Homo sapiens
gacttcccaacctcc

SEQ ID NO: 497316 - DNA, 15 bp, Homo sapiens
acttcccaacctcca

SEQ ID NO: 497317 - DNA, 15 bp, Homo sapiens
cttcccaacctccag

SEQ ID NO: 497318 - DNA, 15 bp, Homo sapiens
ttcccaacctccaga

SEQ ID NO: 497319 - DNA, 15 bp, Homo sapiens
tcccaacctccagaa

SEQ ID NO: 497320 - DNA, 15 bp, Homo sapiens
cccaacctccagaac

SEQ ID NO: 497321 - DNA, 15 bp, Homo sapiens
ccaacctccagaacg

SEQ ID NO: 497322 - DNA, 15 bp, Homo sapiens
caacctccagaacgc

SEQ ID NO: 497323 - DNA, 15 bp, Homo sapiens
aacctccagaacgct

SEQ ID NO: 497324 - DNA, 15 bp, Homo sapiens
acctccagaacgctg

SEQ ID NO: 497325 - DNA, 15 bp, Homo sapiens
cctccagaacgctga

SEQ ID NO: 497326 - DNA, 15 bp, Homo sapiens
ctccagaacgctgag

SEQ ID NO: 497327 - DNA, 15 bp, Homo sapiens
tccagaacgctgaga

SEQ ID NO: 497328 - DNA, 15 bp, Homo sapiens
ccagaacgctgagaa

SEQ ID NO: 497329 - DNA, 15 bp, Homo sapiens
cagaacgctgagaaa

SEQ ID NO: 497330 - DNA, 15 bp, Homo sapiens
agaacgctgagaaat

SEQ ID NO: 497331 - DNA, 15 bp, Homo sapiens
gaacgctgagaaata

SEQ ID NO: 497332 - DNA, 15 bp, Homo sapiens
aacgctgagaaataa

SEQ ID NO: 497333 - DNA, 15 bp, Homo sapiens
acgctgagaaataaa

SEQ ID NO: 497334 - DNA, 15 bp, Homo sapiens
cgctgagaaataaat

SEQ ID NO: 497335 - DNA, 15 bp, Homo sapiens
gctgagaaataaatt

SEQ ID NO: 497336 - DNA, 15 bp, Homo sapiens
ctgagaaataaattt

SEQ ID NO: 497337 - DNA, 15 bp, Homo sapiens
tgagaaataaatttc

SEQ ID NO: 497338 - DNA, 15 bp, Homo sapiens
gagaaataaatttct

SEQ ID NO: 497339 - DNA, 15 bp, Homo sapiens
agaaataaatttctt

SEQ ID NO: 497340 - DNA, 15 bp, Homo sapiens
gaaataaatttcttt

SEQ ID NO: 497341 - DNA, 15 bp, Homo sapiens
aaataaatttctttt

SEQ ID NO: 497342 - DNA, 15 bp, Homo sapiens
aataaatttcttttc

SEQ ID NO: 497343 - DNA, 15 bp, Homo sapiens
ataaatttcttttct

SEQ ID NO: 497344 - DNA, 15 bp, Homo sapiens
taaatttcttttctt

SEQ ID NO: 497345 - DNA, 15 bp, Homo sapiens
aaatttcttttcttt

SEQ ID NO: 497346 - DNA, 15 bp, Homo sapiens
aatttcttttctttg

SEQ ID NO: 497347 - DNA, 15 bp, Homo sapiens
atttcttttctttgt

SEQ ID NO: 497348 - DNA, 15 bp, Homo sapiens
tttcttttctttgta

SEQ ID NO: 497349 - DNA, 15 bp, Homo sapiens
ttcttttctttgtaa

SEQ ID NO: 497350 - DNA, 15 bp, Homo sapiens
tcttttctttgtaaa

SEQ ID NO: 497351 - DNA, 15 bp, Homo sapiens
cttttctttgtaaat

SEQ ID NO: 497352 - DNA, 15 bp, Homo sapiens
ttttctttgtaaatt

SEQ ID NO: 497353 - DNA, 15 bp, Homo sapiens
tttctttgtaaatta

SEQ ID NO: 497354 - DNA, 15 bp, Homo sapiens
ttctttgtaaattac

SEQ ID NO: 497355 - DNA, 15 bp, Homo sapiens
tctttgtaaattacc

SEQ ID NO: 497356 - DNA, 15 bp, Homo sapiens
ttgtaaattacccaa

SEQ ID NO: 497357 - DNA, 15 bp, Homo sapiens
tgtaaattacccaat

SEQ ID NO: 497358 - DNA, 15 bp, Homo sapiens
gtaaattacccaatc

SEQ ID NO: 497359 - DNA, 15 bp, Homo sapiens
taaattacccaatct

SEQ ID NO: 497360 - DNA, 15 bp, Homo sapiens
aaattacccaatctg

SEQ ID NO: 497361 - DNA, 15 bp, Homo sapiens
aattacccaatctgt

SEQ ID NO: 497362 - DNA, 15 bp, Homo sapiens
attacccaatctgtg

SEQ ID NO: 497363 - DNA, 15 bp, Homo sapiens
ttacccaatctgtgg

SEQ ID NO: 497364 - DNA, 15 bp, Homo sapiens
tacccaatctgtggt

SEQ ID NO: 497365 - DNA, 15 bp, Homo sapiens
acccaatctgtggta

SEQ ID NO: 497366 - DNA, 15 bp, Homo sapiens
cccaatctgtggtat

SEQ ID NO: 497367 - DNA, 15 bp, Homo sapiens
ccaatctgtggtatt

SEQ ID NO: 497368 - DNA, 15 bp, Homo sapiens
caatctgtggtattc

SEQ ID NO: 497369 - DNA, 15 bp, Homo sapiens
aatctgtggtattct

SEQ ID NO: 497370 - DNA, 15 bp, Homo sapiens
atctgtggtattctg

SEQ ID NO: 497371 - DNA, 15 bp, Homo sapiens
tctgtggtattctgt

SEQ ID NO: 497372 - DNA, 15 bp, Homo sapiens
ctgtggtattctgtt

SEQ ID NO: 497373 - DNA, 15 bp, Homo sapiens
tgtggtattctgtta

SEQ ID NO: 497374 - DNA, 15 bp, Homo sapiens
gtggtattctgttat

SEQ ID NO: 497375 - DNA, 15 bp, Homo sapiens
tggtattctgttata

SEQ ID NO: 497376 - DNA, 15 bp, Homo sapiens
ggtattctgttatag

SEQ ID NO: 497377 - DNA, 15 bp, Homo sapiens
attctgttatagcaa

SEQ ID NO: 497378 - DNA, 15 bp, Homo sapiens
ttctgttatagcaac

SEQ ID NO: 497379 - DNA, 15 bp, Homo sapiens
tctgttatagcaaca

SEQ ID NO: 497380 - DNA, 15 bp, Homo sapiens
ctgttatagcaacac

SEQ ID NO: 497381 - DNA, 15 bp, Homo sapiens
tgttatagcaacaca

SEQ ID NO: 497382 - DNA, 15 bp, Homo sapiens
gttatagcaacacaa

SEQ ID NO: 497383 - DNA, 15 bp, Homo sapiens
ttatagcaacacaaa

SEQ ID NO: 497384 - DNA, 15 bp, Homo sapiens
tatagcaacacaaaa

SEQ ID NO: 497385 - DNA, 15 bp, Homo sapiens
atagcaacacaaaat

SEQ ID NO: 497386 - DNA, 15 bp, Homo sapiens
tagcaacacaaaata

SEQ ID NO: 497387 - DNA, 15 bp, Homo sapiens
agcaacacaaaatag

SEQ ID NO: 497388 - DNA, 15 bp, Homo sapiens
gcaacacaaaataga

SEQ ID NO: 497389 - DNA, 15 bp, Homo sapiens
caacacaaaatagaa

SEQ ID NO: 497390 - DNA, 15 bp, Homo sapiens
aacacaaaatagaat

SEQ ID NO: 497391 - DNA, 15 bp, Homo sapiens
acacaaaatagaata

SEQ ID NO: 497392 - DNA, 15 bp, Homo sapiens
cacaaaatagaataa

SEQ ID NO: 497393 - DNA, 15 bp, Homo sapiens
acaaaatagaataaa

SEQ ID NO: 497394 - DNA, 15 bp, Homo sapiens
caaaatagaataaag

SEQ ID NO: 497395 - DNA, 15 bp, Homo sapiens
aaaatagaataaaga

SEQ ID NO: 497396 - DNA, 15 bp, Homo sapiens
aaatagaataaagat

SEQ ID NO: 497397 - DNA, 15 bp, Homo sapiens
aatagaataaagatg

SEQ ID NO: 497398 - DNA, 15 bp, Homo sapiens
atagaataaagatgt

SEQ ID NO: 497399 - DNA, 15 bp, Homo sapiens
tagaataaagatgta

SEQ ID NO: 497400 - DNA, 15 bp, Homo sapiens
agaataaagatgtat

SEQ ID NO: 497401 - DNA, 15 bp, Homo sapiens
gaataaagatgtata

SEQ ID NO: 497402 - DNA, 15 bp, Homo sapiens
aataaagatgtatac

SEQ ID NO: 497403 - DNA, 15 bp, Homo sapiens
ataaagatgtatact

SEQ ID NO: 497404 - DNA, 15 bp, Homo sapiens
taaagatgtatactg

SEQ ID NO: 497405 - DNA, 15 bp, Homo sapiens
aaagatgtatactgt

SEQ ID NO: 497406 - DNA, 15 bp, Homo sapiens
aagatgtatactgtg

SEQ ID NO: 497407 - DNA, 15 bp, Homo sapiens
agatgtatactgtgc

SEQ ID NO: 497408 - DNA, 15 bp, Homo sapiens
gatgtatactgtgcc

SEQ ID NO: 497409 - DNA, 15 bp, Homo sapiens
atgtatactgtgcct

SEQ ID NO: 497410 - DNA, 15 bp, Homo sapiens
tgtatactgtgcctt

SEQ ID NO: 497411 - DNA, 15 bp, Homo sapiens
gtatactgtgccttc

SEQ ID NO: 497412 - DNA, 15 bp, Homo sapiens
tatactgtgccttca

SEQ ID NO: 497413 - DNA, 15 bp, Homo sapiens
atactgtgccttcaa

SEQ ID NO: 497414 - DNA, 15 bp, Homo sapiens
tactgtgccttcaag

SEQ ID NO: 497415 - DNA, 15 bp, Homo sapiens
actgtgccttcaagt

SEQ ID NO: 497416 - DNA, 15 bp, Homo sapiens
ctgtgccttcaagtt

SEQ ID NO: 497417 - DNA, 15 bp, Homo sapiens
tgtgccttcaagttg

SEQ ID NO: 497418 - DNA, 15 bp, Homo sapiens
gtgccttcaagttgt

SEQ ID NO: 497419 - DNA, 15 bp, Homo sapiens
tgccttcaagttgtt

SEQ ID NO: 497420 - DNA, 15 bp, Homo sapiens
gccttcaagttgtta

SEQ ID NO: 497421 - DNA, 15 bp, Homo sapiens
ccttcaagttgttat

SEQ ID NO: 497422 - DNA, 15 bp, Homo sapiens
cttcaagttgttata

SEQ ID NO: 497423 - DNA, 15 bp, Homo sapiens
ttcaagttgttatat

SEQ ID NO: 497424 - DNA, 15 bp, Homo sapiens
tcaagttgttatata

SEQ ID NO: 497425 - DNA, 15 bp, Homo sapiens
caagttgttatatat

SEQ ID NO: 497426 - DNA, 15 bp, Homo sapiens
aagttgttatatatc

SEQ ID NO: 497427 - DNA, 15 bp, Homo sapiens
agttgttatatatca

SEQ ID NO: 497428 - DNA, 15 bp, Homo sapiens
gttgttatatatcac

SEQ ID NO: 497429 - DNA, 15 bp, Homo sapiens
ttgttatatatcaca

SEQ ID NO: 497430 - DNA, 15 bp, Homo sapiens
tgttatatatcacat

SEQ ID NO: 497431 - DNA, 15 bp, Homo sapiens
gttatatatcacata

SEQ ID NO: 497432 - DNA, 15 bp, Homo sapiens
ttatatatcacatat

SEQ ID NO: 497433 - DNA, 15 bp, Homo sapiens
tatatatcacatata

SEQ ID NO: 497434 - DNA, 15 bp, Homo sapiens
atatatcacatatat

SEQ ID NO: 497435 - DNA, 15 bp, Homo sapiens
tatatcacatatata

SEQ ID NO: 497436 - DNA, 15 bp, Homo sapiens
atatcacatatatat

SEQ ID NO: 497437 - DNA, 15 bp, Homo sapiens
tatcacatatatata

SEQ ID NO: 497438 - DNA, 15 bp, Homo sapiens
atcacatatatatat

SEQ ID NO: 497439 - DNA, 15 bp, Homo sapiens
tcacatatatatata

SEQ ID NO: 497440 - DNA, 15 bp, Homo sapiens
cacatatatatataa

SEQ ID NO: 497441 - DNA, 15 bp, Homo sapiens
acatatatatataat

SEQ ID NO: 497442 - DNA, 15 bp, Homo sapiens
catatatatataata

SEQ ID NO: 497443 - DNA, 15 bp, Homo sapiens
tatataatatatatg

SEQ ID NO: 497444 - DNA, 15 bp, Homo sapiens
atataatatatatgt

SEQ ID NO: 497445 - DNA, 15 bp, Homo sapiens
tataatatatatgtt

SEQ ID NO: 497446 - DNA, 15 bp, Homo sapiens
ataatatatatgtta

SEQ ID NO: 497447 - DNA, 15 bp, Homo sapiens
taatatatatgttac

SEQ ID NO: 497448 - DNA, 15 bp, Homo sapiens
aatatatatgttaca

SEQ ID NO: 497449 - DNA, 15 bp, Homo sapiens
atatatatgttacaa

SEQ ID NO: 497450 - DNA, 15 bp, Homo sapiens
tatatatgttacaat

SEQ ID NO: 497451 - DNA, 15 bp, Homo sapiens
atatatgttacaatc

SEQ ID NO: 497452 - DNA, 15 bp, Homo sapiens
tatatgttacaatca

SEQ ID NO: 497453 - DNA, 15 bp, Homo sapiens
atatgttacaatcaa

SEQ ID NO: 497454 - DNA, 15 bp, Homo sapiens
tatgttacaatcaag

SEQ ID NO: 497455 - DNA, 15 bp, Homo sapiens
atgttacaatcaagg

SEQ ID NO: 497456 - DNA, 15 bp, Homo sapiens
tgttacaatcaaggc

SEQ ID NO: 497457 - DNA, 15 bp, Homo sapiens
gttacaatcaaggca

SEQ ID NO: 497458 - DNA, 15 bp, Homo sapiens
ttacaatcaaggcac

SEQ ID NO: 497459 - DNA, 15 bp, Homo sapiens
tacaatcaaggcaca

SEQ ID NO: 497460 - DNA, 15 bp, Homo sapiens
acaatcaaggcacag

SEQ ID NO: 497461 - DNA, 15 bp, Homo sapiens
caatcaaggcacagt

SEQ ID NO: 497462 - DNA, 15 bp, Homo sapiens
aatcaaggcacagta

SEQ ID NO: 497463 - DNA, 15 bp, Homo sapiens
atcaaggcacagtat

SEQ ID NO: 497464 - DNA, 15 bp, Homo sapiens
tcaaggcacagtata

SEQ ID NO: 497465 - DNA, 15 bp, Homo sapiens
caaggcacagtatac

SEQ ID NO: 497466 - DNA, 15 bp, Homo sapiens
aaggcacagtatact

SEQ ID NO: 497467 - DNA, 15 bp, Homo sapiens
aggcacagtatacta

SEQ ID NO: 497468 - DNA, 15 bp, Homo sapiens
ggcacagtatactat

SEQ ID NO: 497469 - DNA, 15 bp, Homo sapiens
gcacagtatactata

SEQ ID NO: 497470 - DNA, 15 bp, Homo sapiens
cacagtatactatat

SEQ ID NO: 497471 - DNA, 15 bp, Homo sapiens
acagtatactatata

SEQ ID NO: 497472 - DNA, 15 bp, Homo sapiens
cagtatactatatat

SEQ ID NO: 497473 - DNA, 15 bp, Homo sapiens
agtatactatatata

SEQ ID NO: 497474 - DNA, 15 bp, Homo sapiens
gtatactatatatac

SEQ ID NO: 497475 - DNA, 15 bp, Homo sapiens
tatactatatatact

SEQ ID NO: 497476 - DNA, 15 bp, Homo sapiens
atactatatatactg

SEQ ID NO: 497477 - DNA, 15 bp, Homo sapiens
tactatatatactgt

SEQ ID NO: 497478 - DNA, 15 bp, Homo sapiens
actatatatactgtg

SEQ ID NO: 497479 - DNA, 15 bp, Homo sapiens
ctatatatactgtga

SEQ ID NO: 497480 - DNA, 15 bp, Homo sapiens
tatatatactgtgaa

SEQ ID NO: 497481 - DNA, 15 bp, Homo sapiens
atatatactgtgaag

SEQ ID NO: 497482 - DNA, 15 bp, Homo sapiens
tatatactgtgaagg

SEQ ID NO: 497483 - DNA, 15 bp, Homo sapiens
atatactgtgaaggc

SEQ ID NO: 497484 - DNA, 15 bp, Homo sapiens
tatactgtgaaggca

SEQ ID NO: 497485 - DNA, 15 bp, Homo sapiens
atactgtgaaggcat

SEQ ID NO: 497486 - DNA, 15 bp, Homo sapiens
tactgtgaaggcata

SEQ ID NO: 497487 - DNA, 15 bp, Homo sapiens
actgtgaaggcatag

SEQ ID NO: 497488 - DNA, 15 bp, Homo sapiens
ctgtgaaggcataga

SEQ ID NO: 497489 - DNA, 15 bp, Homo sapiens
tgtgaaggcatagag

SEQ ID NO: 497490 - DNA, 15 bp, Homo sapiens
gtgaaggcatagaga

SEQ ID NO: 497491 - DNA, 15 bp, Homo sapiens
tgaaggcatagagat

SEQ ID NO: 497492 - DNA, 15 bp, Homo sapiens
gaaggcatagagata

SEQ ID NO: 497493 - DNA, 15 bp, Homo sapiens
aaggcatagagatag

SEQ ID NO: 497494 - DNA, 15 bp, Homo sapiens
aggcatagagataga

SEQ ID NO: 497495 - DNA, 15 bp, Homo sapiens
ggcatagagatagat

SEQ ID NO: 497496 - DNA, 15 bp, Homo sapiens
gcatagagatagatg

SEQ ID NO: 497497 - DNA, 15 bp, Homo sapiens
catagagatagatga

SEQ ID NO: 497498 - DNA, 15 bp, Homo sapiens
atagagatagatgat

SEQ ID NO: 497499 - DNA, 15 bp, Homo sapiens
tagagatagatgata

SEQ ID NO: 497500 - DNA, 15 bp, Homo sapiens
agagatagatgatag

SEQ ID NO: 497501 - DNA, 15 bp, Homo sapiens
gagatagatgataga

SEQ ID NO: 497502 - DNA, 15 bp, Homo sapiens
agatagatgatagat

SEQ ID NO: 497503 - DNA, 15 bp, Homo sapiens
gatagatgatagatg

SEQ ID NO: 497504 - DNA, 15 bp, Homo sapiens
atagatgatagatga

SEQ ID NO: 497505 - DNA, 15 bp, Homo sapiens
tagatgatagatgat

SEQ ID NO: 497506 - DNA, 15 bp, Homo sapiens
agatgatagatgata

SEQ ID NO: 497507 - DNA, 15 bp, Homo sapiens
gatgatagatgatag

SEQ ID NO: 497508 - DNA, 15 bp, Homo sapiens
atgatagatgataga

SEQ ID NO: 497509 - DNA, 15 bp, Homo sapiens
tgatagatgatagat

SEQ ID NO: 497510 - DNA, 15 bp, Homo sapiens
gatagatgatagata

SEQ ID NO: 497511 - DNA, 15 bp, Homo sapiens
atagatgatagatat

SEQ ID NO: 497512 - DNA, 15 bp, Homo sapiens
tagatgatagatata

SEQ ID NO: 497513 - DNA, 15 bp, Homo sapiens
agatgatagatatag

SEQ ID NO: 497514 - DNA, 15 bp, Homo sapiens
gatgatagatataga

SEQ ID NO: 497515 - DNA, 15 bp, Homo sapiens
atgatagatatagat

SEQ ID NO: 497516 - DNA, 15 bp, Homo sapiens
tgatagatatagata

SEQ ID NO: 497517 - DNA, 15 bp, Homo sapiens
gatagatatagatag

SEQ ID NO: 497518 - DNA, 15 bp, Homo sapiens
atagatatagataga

SEQ ID NO: 497519 - DNA, 15 bp, Homo sapiens
tagatatagatagat

SEQ ID NO: 497520 - DNA, 15 bp, Homo sapiens
agatatagatagata

SEQ ID NO: 497521 - DNA, 15 bp, Homo sapiens
gatatagatagatag

SEQ ID NO: 497522 - DNA, 15 bp, Homo sapiens
atagatagatagata

SEQ ID NO: 497523 - DNA, 15 bp, Homo sapiens
tagatagatagatag

SEQ ID NO: 497524 - DNA, 15 bp, Homo sapiens
agatagatagataga

SEQ ID NO: 497525 - DNA, 15 bp, Homo sapiens
gatagatagatagat

SEQ ID NO: 497526 - DNA, 15 bp, Homo sapiens
atagatagatagatg

SEQ ID NO: 497527 - DNA, 15 bp, Homo sapiens
tagatagatagatga

SEQ ID NO: 497528 - DNA, 15 bp, Homo sapiens
agatagatagatgat

SEQ ID NO: 497529 - DNA, 15 bp, Homo sapiens
gatagatagatgata

SEQ ID NO: 497530 - DNA, 15 bp, Homo sapiens
atagatagatgatag

SEQ ID NO: 497531 - DNA, 15 bp, Homo sapiens
tagatagatgataga

SEQ ID NO: 497532 - DNA, 15 bp, Homo sapiens
atagatgatagatag

SEQ ID NO: 497533 - DNA, 15 bp, Homo sapiens
tagatgatagataga

SEQ ID NO: 497534 - DNA, 15 bp, Homo sapiens
agatgatagatagat

SEQ ID NO: 497535 - DNA, 15 bp, Homo sapiens
gatgatagatagatg

SEQ ID NO: 497536 - DNA, 15 bp, Homo sapiens
atgatagatagatga

SEQ ID NO: 497537 - DNA, 15 bp, Homo sapiens
tgatagatagatgat

SEQ ID NO: 497538 - DNA, 15 bp, Homo sapiens
gatgatagatagata

SEQ ID NO: 497539 - DNA, 15 bp, Homo sapiens
atgatagatagatat

SEQ ID NO: 497540 - DNA, 15 bp, Homo sapiens
tgatagatagatata

SEQ ID NO: 497541 - DNA, 15 bp, Homo sapiens
gatagatagatatag

SEQ ID NO: 497542 - DNA, 15 bp, Homo sapiens
atagatagatataga

SEQ ID NO: 497543 - DNA, 15 bp, Homo sapiens
tagatagatatagat

SEQ ID NO: 497544 - DNA, 15 bp, Homo sapiens
agatagatatagata

SEQ ID NO: 497545 - DNA, 15 bp, Homo sapiens
agatatagatagatg

SEQ ID NO: 497546 - DNA, 15 bp, Homo sapiens
gatatagatagatga

SEQ ID NO: 497547 - DNA, 15 bp, Homo sapiens
atatagatagatgat

SEQ ID NO: 497548 - DNA, 15 bp, Homo sapiens
tatagatagatgata

SEQ ID NO: 497549 - DNA, 15 bp, Homo sapiens
atgatagatagatag

SEQ ID NO: 497550 - DNA, 15 bp, Homo sapiens
tgatagatagataga

SEQ ID NO: 497551 - DNA, 15 bp, Homo sapiens
gatagatagagatag

SEQ ID NO: 497552 - DNA, 15 bp, Homo sapiens
atagatagagataga

SEQ ID NO: 497553 - DNA, 15 bp, Homo sapiens
tagatagagatagac

SEQ ID NO: 497554 - DNA, 15 bp, Homo sapiens
agatagagatagaca

SEQ ID NO: 497555 - DNA, 15 bp, Homo sapiens
gatagagatagacag

SEQ ID NO: 497556 - DNA, 15 bp, Homo sapiens
atagagatagacaga

SEQ ID NO: 497557 - DNA, 15 bp, Homo sapiens
tagagatagacagac

SEQ ID NO: 497558 - DNA, 15 bp, Homo sapiens
agagatagacagaca

SEQ ID NO: 497559 - DNA, 15 bp, Homo sapiens
gagatagacagacag

SEQ ID NO: 497560 - DNA, 15 bp, Homo sapiens
agatagacagacaga

SEQ ID NO: 497561 - DNA, 15 bp, Homo sapiens
gatagacagacagat

SEQ ID NO: 497562 - DNA, 15 bp, Homo sapiens
atagacagacagata

SEQ ID NO: 497563 - DNA, 15 bp, Homo sapiens
tagacagacagataa

SEQ ID NO: 497564 - DNA, 15 bp, Homo sapiens
agacagacagataat

SEQ ID NO: 497565 - DNA, 15 bp, Homo sapiens
gacagacagataatc

SEQ ID NO: 497566 - DNA, 15 bp, Homo sapiens
acagacagataatct

SEQ ID NO: 497567 - DNA, 15 bp, Homo sapiens
cagacagataatctt

SEQ ID NO: 497568 - DNA, 15 bp, Homo sapiens
agacagataatcttt

SEQ ID NO: 497569 - DNA, 15 bp, Homo sapiens
gacagataatctttg

SEQ ID NO: 497570 - DNA, 15 bp, Homo sapiens
acagataatctttgt

SEQ ID NO: 497571 - DNA, 15 bp, Homo sapiens
cagataatctttgta

SEQ ID NO: 497572 - DNA, 15 bp, Homo sapiens
agataatctttgtag

SEQ ID NO: 497573 - DNA, 15 bp, Homo sapiens
gataatctttgtagt

SEQ ID NO: 497574 - DNA, 15 bp, Homo sapiens
ataatctttgtagtt

SEQ ID NO: 497575 - DNA, 15 bp, Homo sapiens
taatctttgtagttt

SEQ ID NO: 497576 - DNA, 15 bp, Homo sapiens
aatctttgtagtttg

SEQ ID NO: 497577 - DNA, 15 bp, Homo sapiens
atctttgtagtttgc

SEQ ID NO: 497578 - DNA, 15 bp, Homo sapiens
tctttgtagtttgct

SEQ ID NO: 497579 - DNA, 15 bp, Homo sapiens
ctttgtagtttgctc

SEQ ID NO: 497580 - DNA, 15 bp, Homo sapiens
tttgtagtttgctcc

SEQ ID NO: 497581 - DNA, 15 bp, Homo sapiens
ttgtagtttgctcct

SEQ ID NO: 497582 - DNA, 15 bp, Homo sapiens
tgtagtttgctcctg

SEQ ID NO: 497583 - DNA, 15 bp, Homo sapiens
gtagtttgctcctgt

SEQ ID NO: 497584 - DNA, 15 bp, Homo sapiens
tagtttgctcctgtg

SEQ ID NO: 497585 - DNA, 15 bp, Homo sapiens
agtttgctcctgtgt

SEQ ID NO: 497586 - DNA, 15 bp, Homo sapiens
gtttgctcctgtgta

SEQ ID NO: 497587 - DNA, 15 bp, Homo sapiens
tttgctcctgtgtat

SEQ ID NO: 497588 - DNA, 15 bp, Homo sapiens
ttgctcctgtgtatc

SEQ ID NO: 497589 - DNA, 15 bp, Homo sapiens
tgctcctgtgtatct

SEQ ID NO: 497590 - DNA, 15 bp, Homo sapiens
gctcctgtgtatctt

SEQ ID NO: 497591 - DNA, 15 bp, Homo sapiens
ctcctgtgtatcttt

SEQ ID NO: 497592 - DNA, 15 bp, Homo sapiens
tcctgtgtatctttt

SEQ ID NO: 497593 - DNA, 15 bp, Homo sapiens
cctgtgtatcttttc

SEQ ID NO: 497594 - DNA, 15 bp, Homo sapiens
ctgtgtatcttttct

SEQ ID NO: 497595 - DNA, 15 bp, Homo sapiens
tgtgtatcttttctc

SEQ ID NO: 497596 - DNA, 15 bp, Homo sapiens
gtgtatcttttctcc

SEQ ID NO: 497597 - DNA, 15 bp, Homo sapiens
tgtatcttttctccc

SEQ ID NO: 497598 - DNA, 15 bp, Homo sapiens
gtatcttttctccca

SEQ ID NO: 497599 - DNA, 15 bp, Homo sapiens
tatcttttctcccac

SEQ ID NO: 497600 - DNA, 15 bp, Homo sapiens
atcttttctcccacc

SEQ ID NO: 497601 - DNA, 15 bp, Homo sapiens
tcttttctcccaccc

SEQ ID NO: 497602 - DNA, 15 bp, Homo sapiens
cttttctcccaccca

SEQ ID NO: 497603 - DNA, 15 bp, Homo sapiens
ttttctcccacccac

SEQ ID NO: 497604 - DNA, 15 bp, Homo sapiens
tttctcccacccaca

SEQ ID NO: 497605 - DNA, 15 bp, Homo sapiens
ttctcccacccacat

SEQ ID NO: 497606 - DNA, 15 bp, Homo sapiens
tctcccacccacatt

SEQ ID NO: 497607 - DNA, 15 bp, Homo sapiens
ctcccacccacattc

SEQ ID NO: 497608 - DNA, 15 bp, Homo sapiens
tcccacccacattca

SEQ ID NO: 497609 - DNA, 15 bp, Homo sapiens
cccacccacattcac

SEQ ID NO: 497610 - DNA, 15 bp, Homo sapiens
ccacccacattcact

SEQ ID NO: 497611 - DNA, 15 bp, Homo sapiens
cacccacattcactg

SEQ ID NO: 497612 - DNA, 15 bp, Homo sapiens
acccacattcactgt

SEQ ID NO: 497613 - DNA, 15 bp, Homo sapiens
cccacattcactgtt

SEQ ID NO: 497614 - DNA, 15 bp, Homo sapiens
ccacattcactgttt

SEQ ID NO: 497615 - DNA, 15 bp, Homo sapiens
cacattcactgtttc

SEQ ID NO: 497616 - DNA, 15 bp, Homo sapiens
acattcactgtttca

SEQ ID NO: 497617 - DNA, 15 bp, Homo sapiens
cattcactgtttcag

SEQ ID NO: 497618 - DNA, 15 bp, Homo sapiens
attcactgtttcagt

SEQ ID NO: 497619 - DNA, 15 bp, Homo sapiens
ttcactgtttcagta

SEQ ID NO: 497620 - DNA, 15 bp, Homo sapiens
tcactgtttcagtat

SEQ ID NO: 497621 - DNA, 15 bp, Homo sapiens
cactgtttcagtatg

SEQ ID NO: 497622 - DNA, 15 bp, Homo sapiens
actgtttcagtatgc

SEQ ID NO: 497623 - DNA, 15 bp, Homo sapiens
ctgtttcagtatgcc

SEQ ID NO: 497624 - DNA, 15 bp, Homo sapiens
tgtttcagtatgcca

SEQ ID NO: 497625 - DNA, 15 bp, Homo sapiens
gtttcagtatgccag

SEQ ID NO: 497626 - DNA, 15 bp, Homo sapiens
tttcagtatgccagc

SEQ ID NO: 497627 - DNA, 15 bp, Homo sapiens
ttcagtatgccagct

SEQ ID NO: 497628 - DNA, 15 bp, Homo sapiens
tcagtatgccagctt

SEQ ID NO: 497629 - DNA, 15 bp, Homo sapiens
cagtatgccagcttt

SEQ ID NO: 497630 - DNA, 15 bp, Homo sapiens
agtatgccagctttt

SEQ ID NO: 497631 - DNA, 15 bp, Homo sapiens
gtatgccagcttttt

SEQ ID NO: 497632 - DNA, 15 bp, Homo sapiens
tatgccagctttttc

SEQ ID NO: 497633 - DNA, 15 bp, Homo sapiens
atgccagctttttca

SEQ ID NO: 497634 - DNA, 15 bp, Homo sapiens
tgccagctttttcaa

SEQ ID NO: 497635 - DNA, 15 bp, Homo sapiens
gccagctttttcaaa

SEQ ID NO: 497636 - DNA, 15 bp, Homo sapiens
ccagctttttcaaag

SEQ ID NO: 497637 - DNA, 15 bp, Homo sapiens
cagctttttcaaagg

SEQ ID NO: 497638 - DNA, 15 bp, Homo sapiens
agctttttcaaaggc

SEQ ID NO: 497639 - DNA, 15 bp, Homo sapiens
gctttttcaaaggcc

SEQ ID NO: 497640 - DNA, 15 bp, Homo sapiens
ctttttcaaaggcct

SEQ ID NO: 497641 - DNA, 15 bp, Homo sapiens
tttttcaaaggcctt

SEQ ID NO: 497642 - DNA, 15 bp, Homo sapiens
ttttcaaaggccttt

SEQ ID NO: 497643 - DNA, 15 bp, Homo sapiens
tttcaaaggcctttc

SEQ ID NO: 497644 - DNA, 15 bp, Homo sapiens
ttcaaaggcctttct

SEQ ID NO: 497645 - DNA, 15 bp, Homo sapiens
tcaaaggcctttcta

SEQ ID NO: 497646 - DNA, 15 bp, Homo sapiens
caaaggcctttctaa

SEQ ID NO: 497647 - DNA, 15 bp, Homo sapiens
aaaggcctttctaaa

SEQ ID NO: 497648 - DNA, 15 bp, Homo sapiens
aaggcctttctaaat

SEQ ID NO: 497649 - DNA, 15 bp, Homo sapiens
aggcctttctaaatt

SEQ ID NO: 497650 - DNA, 15 bp, Homo sapiens
ggcctttctaaattc

SEQ ID NO: 497651 - DNA, 15 bp, Homo sapiens
gcctttctaaattca

SEQ ID NO: 497652 - DNA, 15 bp, Homo sapiens
cctttctaaattcat

SEQ ID NO: 497653 - DNA, 15 bp, Homo sapiens
ctttctaaattcatt

SEQ ID NO: 497654 - DNA, 15 bp, Homo sapiens
tttctaaattcatta

SEQ ID NO: 497655 - DNA, 15 bp, Homo sapiens
ttctaaattcattag

SEQ ID NO: 497656 - DNA, 15 bp, Homo sapiens
tctaaattcattagt

SEQ ID NO: 497657 - DNA, 15 bp, Homo sapiens
ctaaattcattagtg

SEQ ID NO: 497658 - DNA, 15 bp, Homo sapiens
taaattcattagtgg

SEQ ID NO: 497659 - DNA, 15 bp, Homo sapiens
aaattcattagtgga

SEQ ID NO: 497660 - DNA, 15 bp, Homo sapiens
aattcattagtggag

SEQ ID NO: 497661 - DNA, 15 bp, Homo sapiens
attcattagtggaga

SEQ ID NO: 497662 - DNA, 15 bp, Homo sapiens
ttcattagtggagaa

SEQ ID NO: 497663 - DNA, 15 bp, Homo sapiens
tcattagtggagaat

SEQ ID NO: 497664 - DNA, 15 bp, Homo sapiens
cattagtggagaatt

SEQ ID NO: 497665 - DNA, 15 bp, Homo sapiens
attagtggagaattt

SEQ ID NO: 497666 - DNA, 15 bp, Homo sapiens
ttagtggagaattta

SEQ ID NO: 497667 - DNA, 15 bp, Homo sapiens
tagtggagaatttaa

SEQ ID NO: 497668 - DNA, 15 bp, Homo sapiens
agtggagaatttaat

SEQ ID NO: 497669 - DNA, 15 bp, Homo sapiens
gtggagaatttaatg

SEQ ID NO: 497670 - DNA, 15 bp, Homo sapiens
tggagaatttaatga

SEQ ID NO: 497671 - DNA, 15 bp, Homo sapiens
ggagaatttaatgat

SEQ ID NO: 497672 - DNA, 15 bp, Homo sapiens
gagaatttaatgata

SEQ ID NO: 497673 - DNA, 15 bp, Homo sapiens
agaatttaatgataa

SEQ ID NO: 497674 - DNA, 15 bp, Homo sapiens
gaatttaatgataat

SEQ ID NO: 497675 - DNA, 15 bp, Homo sapiens
atttaatgataatac

SEQ ID NO: 497676 - DNA, 15 bp, Homo sapiens
tttaatgataataca

SEQ ID NO: 497677 - DNA, 15 bp, Homo sapiens
ttaatgataatacag

SEQ ID NO: 497678 - DNA, 15 bp, Homo sapiens
taatgataatacagt

SEQ ID NO: 497679 - DNA, 15 bp, Homo sapiens
aatgataatacagta

SEQ ID NO: 497680 - DNA, 15 bp, Homo sapiens
atgataatacagtaa

SEQ ID NO: 497681 - DNA, 15 bp, Homo sapiens
tgataatacagtaaa

SEQ ID NO: 497682 - DNA, 15 bp, Homo sapiens
gataatacagtaaac

SEQ ID NO: 497683 - DNA, 15 bp, Homo sapiens
ataatacagtaaacc

SEQ ID NO: 497684 - DNA, 15 bp, Homo sapiens
taatacagtaaacca

SEQ ID NO: 497685 - DNA, 15 bp, Homo sapiens
aatacagtaaaccac

SEQ ID NO: 497686 - DNA, 15 bp, Homo sapiens
atacagtaaaccacc

SEQ ID NO: 497687 - DNA, 15 bp, Homo sapiens
tacagtaaaccacca

SEQ ID NO: 497688 - DNA, 15 bp, Homo sapiens
acagtaaaccaccac

SEQ ID NO: 497689 - DNA, 15 bp, Homo sapiens
cagtaaaccaccact

SEQ ID NO: 497690 - DNA, 15 bp, Homo sapiens
agtaaaccaccacta

SEQ ID NO: 497691 - DNA, 15 bp, Homo sapiens
gtaaaccaccactaa

SEQ ID NO: 497692 - DNA, 15 bp, Homo sapiens
taaaccaccactaac

SEQ ID NO: 497693 - DNA, 15 bp, Homo sapiens
aaaccaccactaacg

SEQ ID NO: 497694 - DNA, 15 bp, Homo sapiens
aaccaccactaacgc

SEQ ID NO: 497695 - DNA, 15 bp, Homo sapiens
accaccactaacgct

SEQ ID NO: 497696 - DNA, 15 bp, Homo sapiens
ccaccactaacgcta

SEQ ID NO: 497697 - DNA, 15 bp, Homo sapiens
caccactaacgctac

SEQ ID NO: 497698 - DNA, 15 bp, Homo sapiens
accactaacgctact

SEQ ID NO: 497699 - DNA, 15 bp, Homo sapiens
ccactaacgctacta

SEQ ID NO: 497700 - DNA, 15 bp, Homo sapiens
cactaacgctactac

SEQ ID NO: 497701 - DNA, 15 bp, Homo sapiens
actaacgctactact

SEQ ID NO: 497702 - DNA, 15 bp, Homo sapiens
ctaacgctactactt

SEQ ID NO: 497703 - DNA, 15 bp, Homo sapiens
taacgctactactta

SEQ ID NO: 497704 - DNA, 15 bp, Homo sapiens
aacgctactacttaa

SEQ ID NO: 497705 - DNA, 15 bp, Homo sapiens
acgctactacttaaa

SEQ ID NO: 497706 - DNA, 15 bp, Homo sapiens
cgctactacttaaac

SEQ ID NO: 497707 - DNA, 15 bp, Homo sapiens
gctactacttaaacc

SEQ ID NO: 497708 - DNA, 15 bp, Homo sapiens
ctactacttaaacct

SEQ ID NO: 497709 - DNA, 15 bp, Homo sapiens
tactacttaaaccta

SEQ ID NO: 497710 - DNA, 15 bp, Homo sapiens
actacttaaacctat

SEQ ID NO: 497711 - DNA, 15 bp, Homo sapiens
ctacttaaacctatg

SEQ ID NO: 497712 - DNA, 15 bp, Homo sapiens
tacttaaacctatga

SEQ ID NO: 497713 - DNA, 15 bp, Homo sapiens
acttaaacctatgag

SEQ ID NO: 497714 - DNA, 15 bp, Homo sapiens
cttaaacctatgagt

SEQ ID NO: 497715 - DNA, 15 bp, Homo sapiens
ttaaacctatgagta

SEQ ID NO: 497716 - DNA, 15 bp, Homo sapiens
taaacctatgagtag

SEQ ID NO: 497717 - DNA, 15 bp, Homo sapiens
aaacctatgagtagg

SEQ ID NO: 497718 - DNA, 15 bp, Homo sapiens
aacctatgagtagga

SEQ ID NO: 497719 - DNA, 15 bp, Homo sapiens
acctatgagtaggat

SEQ ID NO: 497720 - DNA, 15 bp, Homo sapiens
cctatgagtaggatc

SEQ ID NO: 497721 - DNA, 15 bp, Homo sapiens
ctatgagtaggatcc

SEQ ID NO: 497722 - DNA, 15 bp, Homo sapiens
tatgagtaggatcca

SEQ ID NO: 497723 - DNA, 15 bp, Homo sapiens
atgagtaggatccaa

SEQ ID NO: 497724 - DNA, 15 bp, Homo sapiens
tgagtaggatccaaa

SEQ ID NO: 497725 - DNA, 15 bp, Homo sapiens
gagtaggatccaaaa

SEQ ID NO: 497726 - DNA, 15 bp, Homo sapiens
agtaggatccaaaag

SEQ ID NO: 497727 - DNA, 15 bp, Homo sapiens
gtaggatccaaaagc

SEQ ID NO: 497728 - DNA, 15 bp, Homo sapiens
taggatccaaaagct

SEQ ID NO: 497729 - DNA, 15 bp, Homo sapiens
ccccgatctattctc

SEQ ID NO: 497730 - DNA, 15 bp, Homo sapiens
cccgatctattctcc

SEQ ID NO: 497731 - DNA, 15 bp, Homo sapiens
ccgatctattctcca

SEQ ID NO: 497732 - DNA, 15 bp, Homo sapiens
gcgcgatgctgaact

SEQ ID NO: 497733 - DNA, 15 bp, Homo sapiens
ctgcgaacagcaatg

SEQ ID NO: 497734 - DNA, 15 bp, Homo sapiens
tgcgaacagcaatgg

SEQ ID NO: 497735 - DNA, 15 bp, Homo sapiens
gcgaacagcaatggc

SEQ ID NO: 497736 - DNA, 15 bp, Homo sapiens
agttctggccagtga

SEQ ID NO: 497737 - DNA, 15 bp, Homo sapiens
agaagtgttattgga

SEQ ID NO: 497738 - DNA, 15 bp, Homo sapiens
gaagtgttattggac

SEQ ID NO: 497739 - DNA, 15 bp, Homo sapiens
ggtagacttgcgcta

SEQ ID NO: 497740 - DNA, 15 bp, Homo sapiens
tagacttgcgctaca

SEQ ID NO: 497741 - DNA, 15 bp, Homo sapiens
agacttgcgctacat

SEQ ID NO: 497742 - DNA, 15 bp, Homo sapiens
gacttgcgctacatt

SEQ ID NO: 497743 - DNA, 15 bp, Homo sapiens
acttgcgctacatta

SEQ ID NO: 497744 - DNA, 15 bp, Homo sapiens
cttgcgctacattaa

SEQ ID NO: 497745 - DNA, 15 bp, Homo sapiens
ttgcgctacattaat

SEQ ID NO: 497746 - DNA, 15 bp, Homo sapiens
tgcgctacattaata

SEQ ID NO: 497747 - DNA, 15 bp, Homo sapiens
gcgctacattaatat

SEQ ID NO: 497748 - DNA, 15 bp, Homo sapiens
gaaagaacagagtga

SEQ ID NO: 497749 - DNA, 15 bp, Homo sapiens
aaagaacagagtgac

SEQ ID NO: 497750 - DNA, 15 bp, Homo sapiens
tccattctggttcgg

SEQ ID NO: 497751 - DNA, 15 bp, Homo sapiens
ccattctggttcggt

SEQ ID NO: 497752 - DNA, 15 bp, Homo sapiens
attctggttcggtct

SEQ ID NO: 497753 - DNA, 15 bp, Homo sapiens
ttctggttcggtctc

SEQ ID NO: 497754 - DNA, 15 bp, Homo sapiens
gtcttcccataacag

SEQ ID NO: 497755 - DNA, 15 bp, Homo sapiens
cccataacagacctt

SEQ ID NO: 497756 - DNA, 15 bp, Homo sapiens
ccataacagaccttc

SEQ ID NO: 497757 - DNA, 15 bp, Homo sapiens
ccgccactgtctcgg

SEQ ID NO: 497758 - DNA, 15 bp, Homo sapiens
ttttcgccgccactg

SEQ ID NO: 497759 - DNA, 15 bp, Homo sapiens
gttttcgccgccact

SEQ ID NO: 497760 - DNA, 15 bp, Homo sapiens
agttttcgccgccac

SEQ ID NO: 497761 - DNA, 15 bp, Homo sapiens
gagttttcgccgcca

SEQ ID NO: 497762 - DNA, 15 bp, Homo sapiens
agagttttcgccgcc

SEQ ID NO: 497763 - DNA, 15 bp, Homo sapiens
gagagttttcgccgc

SEQ ID NO: 497764 - DNA, 15 bp, Homo sapiens
cagagagttttcgcc

SEQ ID NO: 497765 - DNA, 15 bp, Homo sapiens
ccgcttacaaggcat

SEQ ID NO: 497766 - DNA, 15 bp, Homo sapiens
gctccgcttacaagg

SEQ ID NO: 497767 - DNA, 15 bp, Homo sapiens
tgctccgcttacaag

SEQ ID NO: 497768 - DNA, 15 bp, Homo sapiens
ttttgctccgcttac

SEQ ID NO: 497769 - DNA, 15 bp, Homo sapiens
acgttgaaccttgtt

SEQ ID NO: 497770 - DNA, 15 bp, Homo sapiens
gacgttgaaccttgt

SEQ ID NO: 497771 - DNA, 15 bp, Homo sapiens
agacgttgaaccttg

SEQ ID NO: 497772 - DNA, 15 bp, Homo sapiens
cagacgttgaacctt

SEQ ID NO: 497773 - DNA, 15 bp, Homo sapiens
gcagacgttgaacct

SEQ ID NO: 497774 - DNA, 15 bp, Homo sapiens
aatgtccaaggcgtg

SEQ ID NO: 497775 - DNA, 15 bp, Homo sapiens
gtcggaattctaatg

SEQ ID NO: 497776 - DNA, 15 bp, Homo sapiens
agtcggaattctaat

SEQ ID NO: 497777 - DNA, 15 bp, Homo sapiens
aagtcggaattctaa

SEQ ID NO: 497778 - DNA, 15 bp, Homo sapiens
gaagtcggaattcta

SEQ ID NO: 497779 - DNA, 15 bp, Homo sapiens
agaagtcggaattct

SEQ ID NO: 497780 - DNA, 15 bp, Homo sapiens
cgttgcgcttctccc

SEQ ID NO: 497781 - DNA, 15 bp, Homo sapiens
gcgttgcgcttctcc

SEQ ID NO: 497782 - DNA, 15 bp, Homo sapiens
agcgttgcgcttctc

SEQ ID NO: 497783 - DNA, 15 bp, Homo sapiens
gagcgttgcgcttct

SEQ ID NO: 497784 - DNA, 15 bp, Homo sapiens
tgagcgttgcgcttc

SEQ ID NO: 497785 - DNA, 15 bp, Homo sapiens
gcgtgtgagcgttgc

SEQ ID NO: 497786 - DNA, 15 bp, Homo sapiens
tgcgtgtgagcgttg

SEQ ID NO: 497787 - DNA, 15 bp, Homo sapiens
gcggtctcttggtgg

SEQ ID NO: 497788 - DNA, 15 bp, Homo sapiens
cgcggtctcttggtg

SEQ ID NO: 497789 - DNA, 15 bp, Homo sapiens
ctgcgcggtctcttg

SEQ ID NO: 497790 - DNA, 15 bp, Homo sapiens
atattcgctatgttt

SEQ ID NO: 497791 - DNA, 15 bp, Homo sapiens
ttcaatatattcgct

SEQ ID NO: 497792 - DNA, 15 bp, Homo sapiens
ttaacgattcaaatt

SEQ ID NO: 497793 - DNA, 15 bp, Homo sapiens
agttaacgattcaaa

SEQ ID NO: 497794 - DNA, 15 bp, Homo sapiens
aagttaacgattcaa

SEQ ID NO: 497795 - DNA, 15 bp, Homo sapiens
actaagttaacgatt

SEQ ID NO: 497796 - DNA, 15 bp, Homo sapiens
aactaagttaacgat

SEQ ID NO: 497797 - DNA, 15 bp, Homo sapiens
cactgcgtaaataca

SEQ ID NO: 497798 - DNA, 15 bp, Homo sapiens
gtgtcactgcgtaaa

SEQ ID NO: 497799 - DNA, 15 bp, Homo sapiens
gtctcgtgcaagttg

SEQ ID NO: 497800 - DNA, 15 bp, Homo sapiens
ataatgtctcgtgca

SEQ ID NO: 497801 - DNA, 15 bp, Homo sapiens
acgctacttgttcag

SEQ ID NO: 497802 - DNA, 15 bp, Homo sapiens
aacgctacttgttca

SEQ ID NO: 497803 - DNA, 15 bp, Homo sapiens
gaacgctacttgttc

SEQ ID NO: 497804 - DNA, 15 bp, Homo sapiens
agaacgctacttgtt

SEQ ID NO: 497805 - DNA, 15 bp, Homo sapiens
aagaacgctacttgt

SEQ ID NO: 497806 - DNA, 15 bp, Homo sapiens
ccaagaacgctactt

SEQ ID NO: 497807 - DNA, 501 bp, Homo sapiens
gcccatcaatgggagaaggtctgttatgggaagactgtattgaattaaaaggttaatatcaggctgagctcagtggctcatacctgtaatcccagcactttgggaggttgatgctattactatctctactttactcaggcacagagcagctaagccatttgtccaggttcacagagctagcaggtggccatgcttacacccacagcacctgatactgtctgaaccattccctaaagtatttctacagaagagtactaataagatttttaaatcctgcaggatttttcttattattcttttcaaatattgtgtaatctaataccatgccatccttgatatctaactcattttagagataaaaatgcttaccctaaataccatcatataatctatatttctataaccccaacagcaatattgcaggttagaatccaagtgtgcagaatatttgtgaagatcagtgtagataatactgaaatgacagtgatgaggaagaaggta

SEQ ID NO: 497808 - DNA, 15 bp, Homo sapiens
ctacgcgtcgacggt

SEQ ID NO: 497809 - DNA, 15 bp, Homo sapiens
ccgattcgcgcgtaa
